United States Patent 11,684,640 (MICROBIOTA COMPOSITION, AS A MARKER OF RESPONSIVENESS TO ANTI-PD1/PD-L1/PD-L2 ANTIBODIES AND USE OF MICROBIAL MODULATORS FOR IMPROVING THE EFFICACY OF AN ANTI-PD1/PD-L1/PD-L2 AB-BASED) - sequence listing, part 2

SEQ ID NO: 1707 - DNA, 861 bp, Fusobacterium sp.
ttgcaaaacactataactaaaaatttcagcgaaaacacaaccaaacaaagttttcttcattctgataagaacaaaaatttattatatattgaaaaaaaacttaatcagattttctttgatgaaatgacatctgataattcaatatttcgaaaagttaaaaattctgccattcataaaatggctttatttttatcaaataacataacaagatcctgctcggtaggaattgcgggagaaacggcaagcggcaaatctacgattgctcttgatataattaatactattcagagttttgctgaagaatattgtattaacaatgcaataaccagaattaataccgatgattattattatgaccgctcggaaatggttaaaaaggcagggagtttcgcggagtttgcaaaacattatgatcttgatgttccagaagcacttgaacttgagcttatgaaaaaacatattaaatcattacttttcggcaatacagttctgctgccggaatatgacatgtcaggaaccgcaataagacgtgacaatgttaaaccggcttatccttctaaaattattatttcggaaggattgtttacattaacagacaaagtcgttgatgcttttgatttcaaaatttatgtagatgtatctcataacatacagaaagaaagattttataaacgtgcagcagaaagagatttaggcgattctgcagatgaagtatatgaaaatgcttcaaacaaagcaaaaacacacattcatcccacggcagcaaaagcggatatcattctttcgggagaagccgacagagcagcttacagaaagtttataaatcaaatacttatgcttgtgaaagaaatttatttttaa

SEQ ID NO: 1708 - DNA, 1032 bp, Fusobacterium sp.
atgttaattaaactgacacatgctcacgtaatcggaacagtaatagcatatttgataggggtatgtcttgtgcctcttgtaataagtttttctaaaaaagaaggacttgttgacgtccctaacgaaagaaaaattcataccaaacctatatcgcgtataggcggtgttgctatttgggcaagtacaatgcttacatttttgtgtcttgtatttatgagttactatccatacggaagtcttctttccggaattcttctgggcggttctttaatgtttttgctggggcttgttgatgatatttacaaccttgatgcaaaattcaagttattcttacaaatttcgattgcaacacttgtttatttgctcggcgttcagataaataacattccttttataggtaatatcggaatattttcttatcccataactttattatggatcgtcggaatttcaaatgctttaaactttattgacggcgttgacgggcttgcggggtctgttgttacggttaatgcagtaacccttgcgattattgcggttgctatgactccttcaaatcctatcagcgcgcttattggttttatccttgcgggttctatgcttgcattcttaacctataactttaatcccgctaaaatatttatgggtgacagcggagctttattttcgggctttttgcttgcaacaatttcaattacgggtgttatgaaagccgctacacttgcaattttactgccgtttctggttcttgccgttcctattatggatattaccttttcttctctgagaaggattgcaaaaggcaaatctccgtttgtggctgatgccgaacatattcaccataagcttttgcatgcaggtttttcacagaaaaagacagtaatgattttgacttccgtggctattattgcaggtgctcttgcctctttatttatgggttccgccacgattaaacactattttatatatatagtcgctatagttattgtgatgttgttgctgaactttataaaagtattgacaaaaaagtaa

SEQ ID NO: 1709 - DNA, 723 bp, Fusobacterium sp.
caagcgtgccgcttgacccgccatacagggaatttttcaaatttttctaacggtttcacacttgcagaagttttaatcacgctggggataataggggtagttgcatcattaactatgcctgcacttttagccaattataaaaagcaggagaccgtaacccgtttaaaaaaggcttatagtattgttgagcaggcaataaaactttcggaagtttataatgaatcttcagaattttggtctacccaattaaacggtaaagatttttttaataaatatataaaaaattatgttcagtatgtaaatgaatattctacaaaagaactatgggatatcgctccaagaaaattattaaacggtaaaaattacagcggtactacctatgccccctcatcagtaaccgcaacaaactttgttctttcagacggcactatgataactcttaactacgtacatccgagtatatgggtaggtatagacgtaaacggattaaaaaagcccaatcaaatcggtaaagatacttttttatttatttttacgaataagtacggactgcagccgttaggaggagcaggaacagaggaagcttggagttacggagaatttgacagggataaagtattaaccagaggcggacatgcctgcaacagaaatcaatcaggctactggtgtgcttctataataatgaatgacggatgggaaatcgcaaaagattatccgtggtaa

SEQ ID NO: 1710 - DNA, 975 bp, Fusobacterium sp.
atggaaaaaacaagggattgcatcaattgtgtaaattacagaaaagcagttatgataggctgcggttttgtgggttcggcatcagcattcagccttatgcagagcggtttgtttaacgagcttgtaatgatagacgcagacagaaaaagagcagaaggagaagcctgggatataagccatggagtacctttcgcaagaccaatgaagatttatgcgggagattatgatgatattaccgatgcctcaattgttattgtcacagcaggagcaaaccagcagccgggagaaacaagacttgatcttgttcaaaaaaatataaaaatatttgaatcaattatccccgaaatttcaaaaagagattttaaaggaattctgcttatcgtatcaaaccctgttgacattcttacatatgtcgcaatcaaattaagcggtctgcctcaaaacagggtaataggttcgggaacggttcttgataccgcaagattgaaatatgccgtaggcgggcacttaaacgtagacagcagaagtgttcatgctttcattataggcgaacacggagacagtgaaattgcagccttcagcagtgcaaacgtttcaggggttccgttgaatacattctgcgaaatgcgcggtcattacgaccacaaatctgctaccgacaaaatagcggaagatgttaaaaacagtgcatacgaaattatttcaagaaaaaaagccacaaattacggtattgcaatgtctgtaaaaagaatttgcgaagcaattgtcagagatgaaaaatcaattcttcctgtttcatcaatgatgcagggcgaatacgggattaacgatgtagtactgagtatgccggcaatagtaggtaaaaacggagtagaaactcatattccgatttctctgaataaaggagaaattgaaaatttgcataagtcggcagatacattaaaaaatattttaaaagaaaataatttactgtaa

SEQ ID NO: 1711 - DNA, 1890 bp, Fusobacterium sp.
atgaggatagaaaaaatgtgcgaacatcaccaccaccacggtcacgaacacagctgtgaaaaccaaaaacttcagcttatcaaaataggcattgcattatttctttttgcaggtgctatgattgcaaatctcagcgggttgtcaagatttcttgtattttttgcggcttacataattgcaggcggagatgttcttttaaaagcatttaaaaatatacttaaaggagaaatttttgacgaaaacttcttaatgggaattgcaactttcggagctttcgcaataaaagaatatcccgaagccgtaatggtaatgattttatatcaaataggagaattccttcaggataaagcagttgaaaaatcccgcaggtcaatttcacaacttatggatatacgccctgattatgcatttgtagaaattaacggacaattaatcaaaaaaaatccttcagacgtaaaagccggagatatgattatcgttaaaacaggcgaaaaaattcctcttgacggtgttgtaaccgagggtcatgcatctgttgatacttctgctttgacaggggaagcgatgcccagagaattaaaaatcggcgaacaagcagtaagcggctgcataaatactaacgggctgttaaaaatcaaagtagaaaaagagttcgggcaatcaaccgtttcaaaaatccttgaacttgttgaacatgcaagttctaaaaaagctaaagcagaaaattttattacaaaatttgcaagatactatactcctgcagtagttgcaggtgcgttagttcttgcagtactgccgccgttgattttacagggtcaattcagcatttggcttcaaagagctttaacatttcttgtaatttcatgtccctgcgcgcttgtaatctctgtacctctgggattttttgcaggaataggcggagcttcaaaagaaggtattttaataaaaggagcctgttatttggaagcactgtcaaatcccgatgccgttgtatttgacaaaacaggaactttaacaaaaggaacttttaaggttacgcaaattcatcctgtaaacgtgacagaagaagaacttctaaagtatacggcatcagccgaaaacttttcaaatcaccctattgcactttctataagaaaagcatattcaaaagaaattgatgcatctcttataaccaatattgaagaaattgcaggcaacggagttaaggcatacgtaaacggagaggaaattatagcaggtaactcacgcttaatggaaatgtttaatatttcttataaacagaacaattcgtcgggcactgttgtttatgccgctaaaaatggagaatatataggttctattgttatctccgacgaaataaaagaagatgcaaaagatacagtaaaaagccttaaacctcttgtcaaacaaatagttatgctgacaggtgataacagtaaaacagcaaaagaaacggttgataagcttggaattgataaatactattcagaacttcttccagcacaaaaagttgaaaagttggaagaattaatcgaaaacaaaaataaaaacaaaagtgttatattcgtcggcgacggaataaacgatgcacctgttttaacccgtgcggatgcaggaattgcaatgggtgctctgggatccgatgctgctgttgaagctgcagatgcggttattatggatgataaaccttccaaaatagtaaaagcaatactcattgccaaaaaaacaatgagtatcgttaaacaaaatattatttttgcacttggaataaaagcattgtttttaatactcggagcattcggcattattacaatgtggggagcagtatttgccgacacgggagttgcattgctcgcagtattaaactctttaagagctttaaaaacttaa

SEQ ID NO: 1712 - DNA, 921 bp, Fusobacterium sp.
atgcttgatgatgtaaatcaaaatgaaaataatgaatatacggagtatcatgagttctcggaaaacgttgaaacggcagaagatactcctattcccgatggaaaacatcttgtaaaaaagaaacgccgtgaacgtcttgttcgtaaaggcagaatgaagcaggaacgatttcgtgcttttgtaagattttttctttcattattttttatattcgggcttggttatgcattgagatgccatggctggtatatggacaaaaacgcttttaactatgtcggcggaagatctgttgaaattataaataataaaattgttccttcgcataaaattcttgttcttttaaaaaacagcaacgttcctaatgttcctgtttatatggcaagaaccgatgcaataaaaaaagaattgatgaagcttccgccggttgagaatgtgtatataagacgttatgcatttcctgcaagaattcaaattatagtgagggagagaattcctgttataactatttcccctgatgtaaaagttcagcccgtagcattttttacaactgacgggaaacttataggcagagaatttcttcctctggataaatcctttaaaacaattcttgttctttcatacggaaataaaggcgatgactaccgcaagtgggatttgaagcaaattcatgaaattgaaaagattgcaaaatatatcgaaacatattccggcgaacccgttgaatatattgaccttagaaaacccgatgatgtttttgtcaaaattaagactgttaatataaggttaggtaagctcgatgaaaatgtttataaaagaattgaaagaattccttctctgttaccgcaggtgaaattaattgattccaaaataaaatatcttgatttaaaatgggataaagtaaactacttaaaattagaataa

SEQ ID NO: 1713 - DNA, 588 bp, Fusobacterium sp.
atgtatgagaaaattaaagttttaggaattttgaccgatagaagttatactatggttaaaaatttttttgtaaatccgtttgaaaaaaaagagaataatgaccctatggctccttcttacataaagcctgacggtactaaggttatagaaaaacaggaagggttaggattaaatgtttatgaaaaatgccctgacggagctttgattttcagaagttatgacaagcaaaaccggcttgtattagattttgcgcgtgacaggaattttgaaataggcaatcagtatgatgatgcaggcaatgttatttataaatacgaatctgtttatgatgagaataacaaacttgcgattaaaaaagagtatgatatagagtattatgacaataatacaaaaaaatccgagataattactgttttcccgaacgaatttacaacttatattcattatgatgaaagcggtaaacgggttgaaaaaatagaagaacgcggaactgttaaaactttctttgatgaaaatgataaaccaataaaaagagagattgacagaggttcaggcggcataattacggaagatttaagaaaccaataa

SEQ ID NO: 1714 - DNA, 327 bp, Fusobacterium sp.
atgaataaggaaaaattaaaaaataatctaagagacatttttaaaacgtcattaccttttttgaagaaaatggctaaagaaaaaattgtaccggtattaataaaaaaatcttatgagctattgtctaaaaaatcacaaaatattattgagcagttaggtaagcttttagaaaaaatcaaaacaacagaaaatatcgaaaaaagaaaggctcatttaatcggatttaaactcggacttgatatcataggggcattaggcaaagaactaactaatgcctatgagcaattgagcagagaacttgcggaaatagaaacctctataaaatag

SEQ ID NO: 1715 - DNA, 798 bp, Fusobacterium sp.
gggattataattatgagtgaaaaagaaaaagttgaaaaagcattagatttttataataaaggagaataccagaaggctattgatattttcagttccgttctcgaaacctgtcaggataacgctgagctttacaataacattgctctatgttatgcaaatcttaacgattttgacagagctgaaaaaaattacctgaaggctcaggagttaaatcctaaattagcacaggtttatattaaccttgccgatatatattaccgcagaaaagatatgggaaacggtatcggacttttaactacaggtatttgcgaaattccggataatcttgttttaagacactatcttgcaagattttatatggaagatgcaagacttgatttggcaattgacgaacttgaaaatattttagaaaaacagcctgataattatgatgtatattatgatttgggcagagtgcattttgagctcggaaattacgcaagtgctattgaaaattttgaaaacgttcttacatataaatccgaaaatccatggatttattactatttaggtgaagcatacgaagcaaacgacgagattgataaagctctttcaaattatttgaaagctatagcccacaatgatgcgttttcacctgcttataagaaatccgcaatcctctttcttgccagaggggattacgatgatgctcttgagtattttgaggattatataaagcttgatattccgaaagaggaaatcaataaaattaaagagttaataggaagaattaagaaaaaacaaaatggcgaaaagtaa

SEQ ID NO: 1716 - DNA, 1197 bp, Fusobacterium sp.
atgaaaaagattttagggattattttaggtttattaatgttacaaaatgtctgccttgctcaaacaggtgtaagttttgtatacataaacggttcaaacaataacgatgaaaaaatgcgcaactggtacattgaaggagttcaaaaacttcatcccgttatgaaaaaaaagtttgaaaaaaacaaagaaattaaacaagtattcttagacaaaacccaatacaaaataaacgaagaaccggtaatttttttctggggtgacaaaagccaaaaagatttggaattcgtgcaggggcagcttgatttgacaaaagcattcagccccacaattgcgtacaaagtcagatcaatgcttgcagcttatttgcacgatgctatttgggtacaaaagcagcataatatgctcccgattttggatgagttaaacgatacagttattaaagaagctcaaaaaggcaataaaacagtattatacggatattcggcaggaagtttcgttacttacgaatatatgtttaataaactcccctatctcaatcctgaagaattgtttaacgaaattgacgtaagtgacaatgtcagaaaattcgcatctgagcatcctcttgaaaatacctgtatatcagcgctttcaaaagctgaaataggcacggtttcgcaaagcggtcatctgatattaaaaaaatttgacgataactcacttgaagaaaattatttgaaattacgggaagcaacaaaaacagcctgtgctcctgcaggttctttacaaggtgttgttaattttgcaagccctcttgtgcttttttattcagaccttgcagatcctgattatgaattgacttattataataaactaatgcttaaatatattatcgaaaacgggttattttttattacggtaaattaccgcgaagacccgctcggttttccaagcactaaaaatcttacaatagatgaaatggaaaaacttgcaaatattgagattgaaaatccgaagggatttgtatacgataattcaagtgtgtggtcaaaacgttcggttctgtttgcacacacttcatactggagcgcgaaaaggactttttctaacgcggttgtaaaagcttttactaacggttacagactgcagtatgacaaagaatttcaggaaaaagttttgaaaaataacaggaaaaaagtaaaatttgaaatgatttaa

SEQ ID NO: 1717 - DNA, 687 bp, Fusobacterium sp.
atgactgacttaacggataccctaaacggtatgaaaaagcgatatcgcgagatttttttgaaatcagttgatgctattcaacaacgtgtagaggaaattaagccttctgatattggaggcgatgtttttgatttatttgataaaaattccaaaggtgaacagtggcaggctgctgtattagatatgtttgaaaatgatatttctcatgaaatttacagaaaatggcgcgaaattttggattaccgcgaaaacttccactgtaagggatgtgcaacatgctgtaaccttgcttgttctgagttttctcccgtggagttgaaaataaaagctgaaaacggagacagatttgcatctcagtttacaagcatttttataccttatgaaagccgtgaggaagctgaaaacatatatcccgaatatctgaaattgctttctgatactttggaagaagatgtttatttttatcattgtcctaaattaaatgaatgcaagcgatgttctgattatgaaaatcgtccgcagatatgtagggatttcccggataaccctttgagcatactgcctgaaagctgcggtttttataaatggggtcaagagggtgaacctgttgttcttatgcttcattcaatgatggaaattattgactattacagacaaaaaataccgtataaaaaggaattaccatga

SEQ ID NO: 1718 - DNA, 423 bp, Fusobacterium sp.
atgacctataactgggcggcgaatttggatatgttagcgcaaaacggtgtattagattatgatgcgccttcatatattaccggtcaaaaacctcgttatgtaggctctcccgatataatcccttcaccttacggcggtcctgcctctgttccgaagataccatatcttagagaacctgatgtggatgaatttcttcacgaaaaacccgataaaaaagatatagttgcaaatccttcgtggaaaaaatgggctttcggtcttataacagcaggagcactaattttcggcggctataagtttaagtctaaaataattccgaagcttaaaaatcttcctaaaactttaaaattagataaattcgggaatttcttaaaaaacggctggaataaatttacaggaatttttaaaagcaagaaaacgtaa

SEQ ID NO: 1719 - DNA, 1338 bp, Fusobacterium sp.
atggcacaaggaatgaaaatgccgacaactgatgatttaatgtcaatgtggcaggcttctggattgaaagaaaaaataatctttactttccttatgattgccgcattcagatttggtgttcagatgcctttgttcggtatcaataaccaaatattctcaaatattgcgcaaggaaacaatatcataggatttttagatttgttttcgggcggtgctttaggtaaagtttcaatatttgcactgggtatcggaccctacattacatcatcaattattatccagcttgtttctgttgtaattccttctttggaaaaactccagaaagaagaaggtgaagcaggcagaagaaaactgtcacagtatacacgtatttttacggttgtattagctgtgtttcagtctttaatctttatgttatacctgcatcatttaccgggagcagttttgcctaacgttaatccgattatgttctttataagttcaattgttgtattaactgcaggttctgttcttgtaatgtggatttctgaacttattacagaaaaaggtatcggtaacggcggatctttaataatctttatcggtatcttatcaggtatcccgatttacgcatcaagaacagcacaaattgttgccaacaattccatgatgcaattaggacttttggttttacttttaatattttttgcggctatgattttcattgtaatcatgcaggaagcagtaagaaaagttattatcgtaaaccccaaaagacaggtcggaaacaaggtatatggcggcatgaattcgtttattccgtttaaacttaaccccggcggtgttatgcctattatctttgctattgcaattttgcttttcccttctactatattaagtttggtgggacaggctaatttcaaaagcgaggctgtaaaaaacgtagtcattcatttaaatcaggttttaagtcctgacggtattgtatactatgttttatatttcttattgattgttgctttgacattcttctatgcatcaattatgccgaatatgcagcctaaagatattgcggataacttaaagaaatacggttcatcaattccgggtgtaaaacctggcagaccgacagcggaagctcttgataaaatattaaccaaaacaacatttatcggagctatgggacttgggattattgctcttgttccgtcactggcaagttatgtaacaaatataaaaactttgcagggtatcggagcaacttcattaataatcatggtcggagttgcacttgatcttataaatcaggtaagaacacacctgctggcaagaaattatgaatcgttcttaaaagaataa

SEQ ID NO: 1720 - DNA, 1581 bp, Fusobacterium sp.
atgaaaacagggattttatcaaattttaaaggcgatttactgggagggataacagcaggtgtaatagccttaccgcttgcaattgcacttggcgtatcaagcggactgggagctgcggcagggatttacggttcaataattgtcgggatgttagccgcaatatttggcggaacaccgacacaaatatcaggtcctacaggacctttgacggttgttgtggcatctgttgctgctgtccattcagataatccgaatttaatatttgccgcaattcttctttcaggactgtttcaaattatactggggcttttaaaagtagggaaacttgtaaactttattccgtatcccgttatatcaggatttatgagcggcataggagcaataataattcttttgcaggtgaactcgtttttaggactggattttaccggaactcctattgacggagttataaatgttgtaaaacatataggaaatacagacttatacagcgtaattcttggagtactcactttaataattgtgtttttcactccaaaaaaacttgcaaatataattccgccgccactgactgctcttattctcggaacattagcagcagtaatcttcaattttgatgtaaaaactattggagaaattccgagaagttttccaaacttaacttttccagcttttaagctgtccgagattgaaacggttattcctattgctttaacgctggctgttctgggttcaattgattctcttttgacatcacttgtcgcggattctcttaccggaacaaagcatcagtcaaataaagaattaatcggacagggtataggaaatatggctgcggctctttttggcggaattgtttcttgcggagcaacaatgagaacggctattaatattaaaagcggcggaagaacaagcctttcaggagttattcattctatattcctgattttcgttattatattctttgcacctgttgccgctaaaattccactgtcagtacttgcgggaattcttattaaagtggggggcagtatcattgattacaaatttataaaacttataaaagcagcaccgagaaatgatttaatagttatgcttcttgtatttttaataactgtatttgatgatttaattcttgcggtcggagtgggtgttgttttatcttcaatcctttttgccgcaaatgtagctaaacagacagatatcaagcttgtcggactttccaatctgtcagacgaaaattatattgatgaagatttaaaaaacaaaaccatgataatgcacattgacggaactttgtttttcggttccgcttcacaaattgcctctagaattgacgctgttatagataacagaacagtaataatagactgctcaaacattaaaagtatggatatctcagccgtttttgctcttgaagacctggttttaacactaaaagggaaaaatgtaagagttataatcattttcaataacagagatgttgccgcatcaaccttaaaactcggcctcagaaaacttataactcacaatgatatagcattttcaaaggaagaagcaattaacagtatacaaaattaa

SEQ ID NO: 1721 - DNA, 1377 bp, Fusobacterium sp.
gtgtttatcgtcaaaaacttactaaaaagcttggaagggtataggaaagtgttacaaagcagtaaattaagcagtagatttaaaaagttagaaaaagaagaaattataaatgaacaacctaaaaaatttgtattctctaaatctgcgcttaaaccgcccgaacctgaagagctgctgcaggaagataaacttgatttgccgtatattgaagaaactttgaaaaatgctttaaccgaaaaaatagattctattcctgtgtggtttgagtatacttctgtacgtcaaaaagagcttataaaaagttttgttgaaaatatgctttcatctgaagattataatcttaacgacgcggaaaaagatacattgattgaaaaattatttacttccgttatgggcttcggacctcttgactatctgctggcaagagaaaatgttgatgccgtttttgtaaacggaacaaacagcgttcatatagaaatcggaggcaaagttttaaatacggaaatgaagcttaatgaaaaacaagtcggatttattcttaacaatatatatgccttgtcaggctgcaaagacgataagcggaataatatttctaattatcgtgtaaaagacttgtttataactgtaataatgcccggattatctcagtgcggtattaatatttcaataaggaagagttttgtccgtagtatcgacaatattttggaaaacggtatgatgacaagagaaatttttgattttcttgtatcaattacagatgccggaaagaatatagtaatttgcggtgatattaattccggtaagacaacgcttatagatacgttaataaatacttctttattaaacaggcgttctgctttaattgaagaaactgcctgtataaattctgcaggcgatacattaatgaaatttaccgttgataaacaatcacctgattactgtgcacttatttcaaacttattaaaaatgtcgccggaatattttattgctgatttaaactcacccgttcccgagctttccgaagtgagcggaagtattataactttacgtgcatcctgtgttgatgccgcaattgcaaaacttatttcgggatttacagggctagaaaaaattcctgaaaaatatgctaaaactaaggtatttaccgattatgattatattgttcaaattaataagatgaacgatggaacaagaaaaattacatcaattgttgagcttgcgcctgcaagaactgcagccttatcggtaaaatccgttgctaaattcgttgacggagaatatattaccgagattccgcagcctttgacttcgattcgggcggagtctttactttctgaatcaggttcgatgtcttcacgtttttatcatcaggattag

SEQ ID NO: 1722 - DNA, 1266 bp, Fusobacterium sp.
ttgataagggataacgtcaaaaacttcattgaaaaatatgatttgtcaggcagatttattctggctttttcaggcggttatgattcaatgtgtcttttggatgttctttgtaatcttggagccgatgtcattgcagttcacctaaaccataattggcggggagaagaaagccttaaagaagcacaaaattgtgaaaaatttgcaaattcccgcggaattaattattattcggaaattctccccgataatatccaaaagacagaaacagccgcaagaaaggctagatatgactttttcagaagatgtgcacaaaaatttaattcaaaagttgttttcacggcacacaatttcgatgataatgctgaaacggttttgtacaggattataagaggaacgggaacagcaggtttgcagggaatttcagaaaaaagagagattttttacagacctctattgcatacgaaaagagaagatatagaaaaatactgcattgataacgggttaaccccgaacaaagacagttcaaacacggacacaaaatacaaaagaaattttataagatataaagttattccgcttttaaaagaaattaatcctgacgtatcaaatgccttaaattcgctttccgaaattgcagcagaagattataacctgataaacagttatcttccttcagagctgcctcaggcatctgaaattgaacaaaaaagaattatatacaacatacttacagagcacaatattgattatgacagagaaaaaatagaaaatattcaaaaatttgttgaggcaaataaaacatccaaatcaggcaaaacaatttctcttacggatggtttatggctttttgtgaacgataaaaaagcagaagttattacaaagacagataaaagcaatactgaaatagccgtaaataagtgcggagaatatgttttcggcgattatatattctcgatagaaccttgtgaagaggaagtaaaacaatttccggatgataatgaatttaaagcatacattacggttaatagtattgatttcacactgcgtaacagaaaagacggcgatataattcatcctttggggtgcaaaggctcgcaaaaactgaaaaaatatcttaatgaaaaaaaaattcctcaacatgaaaaagataaacttatatttttgtgtaaggggaatgaagttatctgggctgcaggtctgggattaagcgaaaaagcgaaagttgcacaaaaagcaacacacgtgctaagattaaaaaagaggtaa

SEQ ID NO: 1723 - DNA, 1389 bp, Fusobacterium sp.
attttaactttgttgtataatttatttatgaagaaatttattgttttgttgggtctttttttattgggaaataacagttttgcatttgatgttgtatatccgaagaaaaatgatgtaataataaatgcaaaatcaacattttttattggttcttctgacaaaccgttaaaaataaacgggatagatgttcctttacatcctacaggtgcttttgcttatgttgtagacttgaattgcggttcaaatactttcattatacagtcaggcggacagagggaaatctttgttattaccagacctgttgtaaaacctgttgctttgtctcaatctgttttttctcaatatccggctaaaaaatctttttatgtgacaacagaaggggcgccgttgcgttcaactcctgttgatgcgggaataaacagaacagcgcatttgcagcgtgatgttaaattggttgttgacggcgaacaggcaggtttttatcgtgttgttctcggtaaggataaattcggctggatatccaaaactaatgtaaaaaacgatactgataataatgcaagtttagcttctcttagcggttatgaatacatagatgatgagaatttctataaatttgtatttcacttagataaaagagtgccttttgaaatggcggaaggcgatatttttcttatgaaattttataacgtaaagaatcaggaagataacacatatataatgaattttcccgtaaaagacgctttaagcggcagaaagttaatagggtacagcggagagtatcagggtaatgattttatattaaagataagaaagcctttaataacaaattcaagacgtccgctgcataatatcagaattgcaattgatgcgggacacggcggttctgagattggagccgtaggctgcctcggagataaggaaaaagatataaatcttgcttttgcaaaacttattgaaaaagaattaaaaaaacgcggagcaagagttattatgaccagaaatgccgacagctatgtaagtttaaaagacagagttgaaatcgcgaattacggggatgccgctgtatttttgagtattcacggtaattcgcttcctgacggttcggatcctaataaaaacagaggaacaagtatttattactattataatcaggcaaagcctcttgcggatataataattaatacattagtttcagaagtcggtgtgcctgatgatcaggttcgtcagggcagtcttgcagttgtaagaaatactaatgcgttgagtctcttaattgaagtttcatatcttataaatccggaagataatgcgaatttaattaatccggagtttcaagctcaatacgcaaaggcaattgcagacagtttggaaaagtattttggacgataa

SEQ ID NO: 1724 - DNA, 1680 bp, Fusobacterium sp.
atgttaatttgtatacctataggatcgctggatgctgttattgctctggcattaaagccttatatggatttggttatggttgaaaaatccatagcttctccatggtatattccgttggggatagttgcatttacatctattcagggaagtttaaaatatttatcttcatatctttcaacctgggtagggggacgaattacaaatggtttaaagttcgatatgttcaaaaaattgttaactttacctacttcattttttgataaaagaaattcaggtgatattgtatttcagtttaataatcaggcggatattgcatgtaacggtttgcttgacaatctgagtgttttcacgcaaagaatattctcctcgatttctcttgtctgtgtgctattttataactcatggcagcttgcattaattgctgttgttattttgggctgtgcttttgtgcctgtcgcaaaaattcagaaaaggataaagagtgtgatggagaaaacagtttttgcagatgcttcaattataacggaatataatgaagtttttgcaggcaataaaactattacatcctataatcttcaaaaaactgaaactaataaatttttaaatattttacaaaatatctttactctaagaataaaaatggttcaaaaaactcaatggctttcacctatgatgcatgtgatcgtatctgtcggaatagcggcagctatcggatacggttcgcatttaattatgtcaaatcagataacaagcggaaattttgtttcgtttattaccgcattaattcttttgtatacacctgtaaaaaatattggtaataatttaaatgctgtacaattctcctttttctctatcgaaaaaatttttgaagtcctggataccattccggaaatacgtgataaagccaatgcagttgtgcttaacggaatacataataaaatagaatttaaagatgtaagttttgaatatattcccaataagccggtcttaaaaaatataaatttaagcgttaattcaggagaaactgttgcttttgtcggaaactccggcggagggaaaacaacaatagtaaatcttattccaaggttttatgatataaaatccggctcaattcagattgacggtactgatataagagattatacgttaaaatctttgagacaaaatattgcagttgtatttcaggataatttcttgttttccggaactattagagaaaatattatgttgggaaatgaaaatgcttcatgcgaagatctggaaaaagctgtaaaaatggcttatttagatgaatttattgccggtttatcctgcggacttgatacgcagataggcgaaaggggaatacttttgtctggcggacagaaacaaagggttgccatagcaagagcttttctcaaaaatgcaccggttgttatattggatgaagcaacttccgcccttgacaataaggcagaagcagtcgtgcaaaaagcaatagaaaatttaatgcaggataaaacagtattcgtaattgcgcacagattaagcactattcggaatgccgataaaattgttgtgataaatgaaggcacaattgtagaaaccggtaaacacgacgaattactgaaaaatataaacggagcttactcaatattgtataatgctcagtttaaaaaacaaacttcggaagttaattaa

SEQ ID NO: 1725 - DNA, 879 bp, Fusobacterium sp.
atgactattctcgcagttaattcattaaacacaaataaaaataacaatattgcctttggttcagcgaaagaaaaagaacataataagacagctgaaacagtttcaaaagctgcaacaatagcaggagctgccgcactcggagttatcggatacaaaaagaattgggcgcaaaagacaattaaatggctttctgaatgtaaaccgatgaaaaacaaagtattcccgaactacgaaaaagataacgcaaaatttatgtctatgatcggggttacatcaattgtacttaaagacggtttaggctgttatttctacgttaaacaaagtttgaataacgataaaatccccgaggataaacgtaaattcgttgccgcactggatttggcaaacggcggcttgatgattgcaatgcaattattaatgttctttacaatatcaaataaaaaagttcagggaaaaatatttaataagttgttcggtaaaaactttacaagagctgccgataaagctctccaggcaaaactcaataaaattgataaactcaaaggaatgtccggtaaagatttccatattgccagagaagctgataaaaaaggacttaaaaacgcattcggttatttaatatctcttgcagcagccacattaatcgcaaaacgtattatagtaccgttcattgcaactcctctggctgacaaaacaaaagcctggatgtcaagaaatgacaaacctgtagaaattcataaggataccaaaaatacttatgacacttcaacacctgcagcaagcaaaacagaagataaaacaacacaatttgcaggaattccggaggaaagccgctctacaaatcttcttgaagaagctaaaaataaagttaataaataa

SEQ ID NO: 1726 - DNA, 897 bp, Lactobacillus salivarius
atggaatataattttgaaaacaaatttgttgaaactgatgaagcaattatctttttcgacaattatattaatattgataatcctaaagagaaatttgtgattattagtcacttatcagctgataacttagcttatttacagcaagcaactttgcctacaaaaacatttgtatctcaaaatttatttttactattacaaaaattaactaaatttgaattgatagctaatttaaatttagatctaaaggttcttccttatggatttgctgtatccgttgctgatttgaaaattactgcactcaataacgatgatggtttatggggatcaatggctctctatttggaacatgatcatcaaaaattaggctatgttgctaaatttgatattcatggaatccacaaaaaacgtattaaagcttggaaaaagttcttttctcaacaaaaattggactacttgattttaggttatcaagattgcgatgatagtgataattatctctttaaaactggccagttaaaaaatattgaaaagactttagaacaaacagatgatactcaaatttatttggaaatgactccttttgatcctgaacaattggtaaaaattgacgatttagcacatcgcctagattatcaaattaagtggctacctggctatgctgagttaatttcttatttcaaacaacttgattttaaagaaaactcccctgctgcaactgataaaactttaattcagcgtgaaactcaaactcatattgctgatgatttgactattagttctccattattaacagaaaatggtgagattgattttatgaagaattttgcttatccaactgaagctgagctaaaagaaattttgaaatatatcgcagctaaacaagtatattttgtttaa

SEQ ID NO: 1727 - DNA, 507 bp, Lactobacillus salivarius
atgaattattatgaagttggaaaaattgtaaatacacatggtattaaaggtgaactaaaaattattagtaagacggacttccctgaagacagatttaagccaggaaacatattatacattagagacaatggaaagattaatagttatgaaattaaaagtcatagaacccataaacaatttgaaatgataacttttaaagggttggaaaatattaatctagtagaaaatttaaagggaaagatactagaaatctctgaagaacagcaagaaaatttatctgatggtaattattatcatcatcaaatcataggtttagatgtctttagtgaggataataactatataggggtaataaaagaaataatgtctcctggagctaatgatgtttgggtagtcaaacgtaaaggctcaagtgatcttttattaccagctattaaagatgtaattaaaaaaattgatttagaacaaaataaagtgattattgaattattagatgggttggattaa

SEQ ID NO: 1728 - DNA, 1221 bp, Lactobacillus salivarius
atgaagtttatagagttattgagaacagcctttcaatctttgaaaactaatcggaaaagaagctttttaacaattatcggtataatgatcgggattgctgccgttattacaattctgggcatgggtgatggtgttaaaaagacgatgtatgataagtttggtaattctaaacaaggacaacagacgacagaaattggatattcttcagtagatatgggctcaacaatacatggttttaccgaagaagatatcgctaatattaagacggaatttggttcagaatttaaagatgtgaagatagaacatgattcattaatcaattctaagatgactattggcgatgaggagaagtctgtaagtattaatttagagaagaaacctgaaaagtcgatcgacttaatagctggtagagagattactaaacaagacttacagatgaaagagccagtagcgatgataaaagaatccttagcaaaaaaagaatttggaactgctcaaaatgcagttggaacttcaatttcatctaatgagacaacttatcgtattattggtgtttatggtggcggaagtaaatatgaccaatatggaacattaagtgcaaaaggaactgatgttgttgttccatataagttatactacgatggtcaaaatgccaatgaaggtgatgtaattaaattaacattccctcaagatgctccggcaagcaaggtatctaaaaagattgctaagtatcttgaaaaaaatggaagtgccatgaataaaggaacatatacatattacgatatggaaaaagaattaaaggcattttcttcacaaattaatatgataactggatttatcagtctaattgcggcaatttctctgttcatcgctggaatcggcgttatgaatatgatgtatatttcagtttcagaacgaactcaagagattggtatccgattagcggtaggggcaactccaactaacattatgttacaatttttaattgaagcgatggttctgactgtaactggtggtctaattggttttgttttaggtgcaggcttatcacatctactggcaccattgctaagcctaggtggaggaattaaaatcaaagcacatattacgctaaatgctttcttattggcgtttggagtttctagtgcagttggtttgatcttcggtatattaccagctagacaagcagcaaataagaatttaattgatatattgagataa

SEQ ID NO: 1729 - DNA, 759 bp, Lactobacillus salivarius
atgaggatagtcaaagtaagaaatgttgaattcggtacggaccgtcctaaaatagctgttccaattaccggaaaatcaagtgatgatattataaagcaagccgaaacaattatgtctagtgataacgctgatttaattgaatggagaatagatttctttgatcaagttgaagatgctgaaaagttggttgaaacagccaaaaagctacgccaagttatgggtgaaatgcctttattaactacatttagaactcatttcgaaggtggagttaaagaattatcagaagaagaatatttcgatatttgtcgcgtattgattaaagaaaaggcaacagatttgttagacttagaattgttcagaaaaacaagtaagctaaaggaaattatcgccgaagctcatgaaaataatatctatattatcatgagtaatcatgatttcgataagactcctgcaacttctgaattagaaagacgactaactttgatgaagacttacggtgctgatattgctaagatcgcagtaatgcctaatagtgcacgtgatgtcctaaatctattactagctacagataatatgaagtacaaattaaattgtccattaattacaatggcgatgggagacttaggtaaagtaaccagaataagtggtgaagtctttggttcttgcttaacatttggtacagtaggcgatgcttctgcaccaggacaaattgaaagtactaacttaaaaggaatcttaaatacattaaagtttgactaa

SEQ ID NO: 1730 - DNA, 582 bp, Lactobacillus salivarius
atgagatttttgatggaaggtgagcttaaaatgaaatgtgcatggatttatggagcggatcagttaatgatagattatcatgataaggagtggggacgtcctttacatgatgaaagaggactattcgaacttttatgtttagaaggattacaggcaggattgagttggaaaatagtattgaataaaagagagtttttaaggaaagcatttgataattttgaagttgaaaagatttcacaatatacttctgatgatgttgaaaaattattgactgatcctaaaataataagaaataaacgaaaaatagaagcaattattaataatgcaaaaatagttaatacattatatgaaagaaatgaatcattggatagttttttctggggaataattgataatcagccaattattaataattttaagaatccggaagaaatacctacaaaaacccaattatctgaacaaatttctaaaacattaaagaagatgggattcaagtttgtaggaccaacgattatctattcatttatggaggctagtggaatggtaaatgatcatttggtagggtgttatggtcgtaattaa

SEQ ID NO: 1731 - DNA, 1317 bp, Lactobacillus salivarius
atgggattaaaggagagtaaaatgatttcacgttatacacgtccagaaatggcagcaatttggaatgatgaaaagaaatacgaatgttggttagcagttgagttagctgcggatgaagcttgggcaaagcttggtcatattcctgatgaagatgttgaaaaattaaagaaaaatgcaaagataaatgtagatcgtattgcagaaatagaagaagtaacacatcatgatgttattgcatttacgcgtgctttatctgagacattaggtgatgaaaagaaatgggtacattatgggttgacgagtacagatgtcgttgatactgcctatggttatcaattaaagcaagtaaatgatattttacgtaaagatttacaaaaatttaaagaaattgttgctcgtaaagctaaaaagtataagaatactgttatgatgggacgtactcatggagtccatgcagaacctactacatttggcttgaaattagcaagatggtattctgagattaatcgtgatattgaacgttttgaacatgctgctaaaggtgtagaagctggtaaaattagtggtgctgttggtacatttgcaaatattgatccttttgttgaaaaatatgtatgtgataaattaggaattagagcacaagaaatttctagtcaagttttaccaagagatttacatgctgaatacttatctgcattggctttaattgctacaagtttggaagaatttgcaactgaaattagaggattgcaaaaatctgaaacacgtgaagtagaagaatattttgcaaaaggtcaaaagggatcttctgcaatgccacataagcgtaatcctattggttctgaaaatatctgcggattagctagagtttgccgaggacatatggtaactgcctttgaaaatgtttctttatggcatgaacgtgatatctctcattcatcagcagaaagaataattttacctgatactacaattttgattgattacatgttacatcgttttggaaagattgttgagaatttaacagtcttccctgaaaatatgaaacgtaatatggatagaacattcggattgatttatagtggacgtgtacttttgaaattaatcgatacaggaatgagtagagaagaggcatacgacttaattcaaccaaaaactgctgaatcttgggataagcaagttccattccgtcctttgttagagcaagatgaagaaatttctaagcgtttatccaaagaagatttagatgatgcgtttgattatcattggcatttacgtcatgtagatgatatttttaaacgcgtgggattagaataa

SEQ ID NO: 1732 - DNA, 690 bp, Lactobacillus salivarius
atgagctactcgaccctattatttgatattgatgataccttattggattttcatgctactgaaaatcgagctctagaattactttttgaaaagcatggaattgaattaactgatactgtaaaagataattatgtaaaatttaatcaaagtctatggaaaaaattagaattgggagaaattagtagacaagaactcatgactaatcgttttactactttctttaaaaaggaatttgatcttaatatcgatggacttagtttgaatagagaatacttagagttcttatcaactggtactgatactattcctggagcaaaagatttactttctactttaaaaaaatctgggcataaattatacgtcgttacaaacggtatagattttgttcaagaacgtcgtttacgcaacaccggattcaattcattttttgatgatatctttatttctcaaaaaattggctatcaaaaaccagatgctagattttttaagaacgtatttaatgagctatctgaattcaatcctgatgatacgcttattgttggtgactcacttacatctgacattcaaggtgggcacaatgctaacatagactctatttggtacaatcctaaattatctcctattgataagaaaattacccctacctatcaagtaaataatttacaggatattttgcaaattgttggttaa

SEQ ID NO: 1733 - DNA, 1119 bp, Lactobacillus salivarius
atgaaccttcctgaatttggtgtagaagcctggttaaataagtgggaaaaaagtgctaaatatgatatatctcaaagttcaattgattctttaacattagaagaattaattggtttagatggtacaaaggtggaggatttttttgctcaacatagtactgataaattaaattatggttggattgaaggatcacctgaatttaaagaattagtagcagaactatatcaaaatatgcccgccgataatattttgcagactaatggtgcaactggtgctaacatgttagcaatctatgctttggttgaggctggggatgaagtgatttcgatgattccttcatatcaacaattatatgatattcctcgttctttaggagctaaggtaaaattgttgaacttggatgagaaacaagactggagttttaaaatagatgaattaaaggaattggtaactcctaaaactaaattaatctgcttaaacaatgccaataatccgactggaacagtgtttgacactgattttatggaagaagttgttaaaatcgctaaagaagtggatgcatatatattagttgatgaagtatatatgcctttaaataaagatagaaaatttgtttcgatagttgatatgtatgataaagggattgctacaaattctttatcaaagacattttctttacctggattgagaatagggtggatagcatcaaataaagaagtagcagacatatttagaaagttccgtgattacacagttatttgtggtggtgtattaaatgatgctttggcagttcatgcactgagaaatagggataaaattctacaaagaaatgaagaaatcgtcaagaataacttggaaatagtagaaaattggttaaaaacagagcctcgagtaagttggtgtacaccacattcagtttctacatcatttataaagctagatattcctcaagatgattattcattttgtgaagatttgctgagagaaaaaggtgttttgttagttccgggaactgcatttgatagaccacaacatgcaagattaggatactgttgtaatcctaagattctacaacaaggtttagaaaagttatcagaatatttgagaaaatttgactaa

SEQ ID NO: 1734 - DNA, 849 bp, Lactobacillus salivarius
atgaaagattataaaaaaattctattatctcgaatagatttaaaaatcctataccttataattattatcctattttcaatattaacattcagaactgttcactatattcgtcaggtaccgttgattaataaagcaattatatatcaatcttataacacgtctagcaaaaacctaggtactttaaatataggtgatcgtgttacagttctttcaactaaatatcattggaaaaaggtaaaaacttcagagggagaagttggttggattcaagattggaactttcaacaacaaaataaaattactagtttatcagatgctactatcgtaatcgatgctggacatggtggctctgattcgggtgccctatctcgtacaaataagaatgaaaagacgtatacgcttatctatgctaaaaaattagcagaaagattgagaaaggctggagcgatggtctatatgactcgagatgatgatagctttgtgagtttaaatagtcgaccacaactagcagaaaatctacatgcggatgcttttattagtattcattttgactctgcacctgaaaataacatagggtcaggatataccacttactattaccataagaagacatctttaagattagcacaagacatcaacagtaagttaaaatacttaaaattagaaaatcgtggggttgaatttggtgattttcttgtaattcgtgaaaatactgtaccagcagttttacttgaaatgggatatattaattcagatagagatttcgaaagaattacttctactagttatcaagatagtgttgttgatgatattaaacaaggattagatacatattttaatcaaaactaa

SEQ ID NO: 1735 - DNA, 399 bp, Lactobacillus salivarius
atggtcatgactgatcctattgcagatttcttaacacgtattcgtaatgctaacatagcaaaacacgaatcattagaagttcctgcatcaaaaatcaaacgtgacattgctgaaatccttaagaatgaaggatttgtacgtgatgttgaatatatcgatgatgacaaacaaggcatcattagagtatttttgaagtatggtaagggtaatgaaagagttatttctggtatccgtcgtatttcaaaaccaggtttacgttcatatgtaaaagcagatgctgttcctaaggttttaaacggtttaggaattgctattttatccacttctgaaggtgttatcactgataaagaagctcgtgccaagaaaattggtggcgaagtaatagcttacatttggtaa

SEQ ID NO: 1736 - DNA, 801 bp, Lactobacillus salivarius
atgtctgctatttcaatgattttagttgttattgtagcgttctttgcaggattggaaggtattttggatcaattccaattccatcaaccattaattgcatgtacattaattggtttagttacaggtaatttaactgccggaattatgttaggtggatctttgcaaatgatcgctttaggttgggctaacattggggctgctgttgctcctgatgctgctttggctgctgttgcatctgctattattttggttaaaggtggtcaaggtacagcaggaatcagtacagctattgctgttgctattcctttagctgttgctggtctattcttaacaatgattgttcgtacgatttctgttgctattattcacattatggataaagaagctgaaaaaggtaatttccgcggtattgaagtttggcaatttattgccttactattacaaggtttacgtatcgcattaccagctgcattcttattagttattccaacaagtgctgtacgttcattcctagaatcaatgccagcttggttaacagatggtatggcaatcggtggtggtatggttgttgccgtaggttatgctatggttatcaatatgatggcatctcgtgaagtatggccattcttcatcattggttttgttattgctgcagtttctcaattgacattaattgctattggtgctttaggtattgcttttgctttaatctacttagagttagaatctaagggtggttcaggcaatggtggttcaagcaatactggagatccacttggcgatattttagatgactactaa

SEQ ID NO: 1737 - DNA, 543 bp, Lactobacillus salivarius
gtgtgtataataaaattatcaattattaaaggagctaggaagaaagtggatgtcaaattttattcaacagctgtggagcataataatttagggaccactcttggtagttctatcttgagggatgctcttctacctgatctagttggaacagataacactattctttactgggcaggcaaacgtttagctcgaaattttccactagctaaagatgaagatttacctgtatttttcgagaaagctaattgggggtacttaaaaagagtaaaatctaagatgaatcgtcaagttttcgaactttcaggtccaatagtcgaaattagaaaaaaaattaattctaaatgtgaatttcttttagaagcaggattcatcgcagaaactatccaaaatcaaagcggatttacttcagaagctgttatcgatactgaaacatctcgtggaaattccgtttttataactgttcaagttgatcaacgtgatcctgttgacttaaatactattcctgacaaggatttactcaatccatctagagaggaactataa

SEQ ID NO: 1738 - DNA, 270 bp, Lactobacillus salivarius
ttggctaaaaaatcaaaaattgctaaatatagaaaacagcaaatgttagttgctaaatatgcagagataagaaaacagttgaaagtaaatcatgattatgagagcttgcgaaaattacctaaagattctaaccctatacgattaaaaaatagagatgaaattgatggtcgtccacgtgcatatatgcgtaagtttaaaatgtcacgtattaattttagagagttggcacatcaaggaaaaataccaggtgtccacaaagcaagttggtag

SEQ ID NO: 1739 - DNA, 1053 bp, Lactobacillus salivarius
atgaaaattcatcaacatcgcaaaaatgaacatctttctttagctgaaaaattttttaaaactcaatcatctaatcagttagatgaagtgcaattaatttatagtaacttacctgagttaaatttatcagatatagatataagaagtacgttagttggtaaagatattcctgtacccttttttattaacgcaattactggaggaagtccacaaactgatgatataaactataaattatcaactgtcgctgctaaaacaaatatacctatggcctgtggctctcaaagtattgctttaaaatatcctagtttatcaccaaatttcagtaaaataaggcaactaaatccaaatggctttttgttaggtaaccttggagcaggtcattcttactcaaacttcaatgttgctcaacaaatgattgatgctaatgcaatggaactgcatcttaatgtttctcaagaattagtcatgcctgaaggcgatactgaatttgtgtggaaagataatattcgtgaaatagttaataattcatcatttcctttacttgttaagggggttggacaaggattaactcctatgactattaaagaattagctgatattggtgttaagtatatcgatctttctggcaaaggtggtactaattttatagaaattgaaaatcgtcgtcgtaaacaaaaagaattagcatttttgcaagatattggtatgactactgctcaatccttagtagctgctaaacttgtagatgaagacatttctttcactgcctctgggggaattagaaattctcttgatatagtaaaatgtttagttttaggagctgacaatgttggtatttctggcctatttttacatattttattacgtcaaggaactgagagtttaattgaatatataactaatttaaaagttgaaataaaaaaagttatgttgatgctaggttgtaaaaatattgatgacttacataaattaccagtaattttaagttctgagttattagtttttaaaaagcaaatgactgagttattaaaaaataaaggttgggattaa

SEQ ID NO: 1740 - DNA, 453 bp, Lactobacillus salivarius
atgaatcaagttcaacactacaaaagaattttgaccccagtggatggttctgaagcagcagaaaaggcattacaaactgcaactgaaatcgccaaaagaaataacgcacatttagatatcttaaatgttattgatttaaagcaattttctgtaagttttggtggaatggtcgatgctaatggtgatgttgtttatcaaacatttgaggatgttgataagtacttgaatgaactattagaaaagactaaagaacaaggcttagaagatgttgaggttcatgcacgttttggctcaccaagaacggttattgctagagaattcccagctgatcatcaaacagatttgatagttatgggacctacaggattgaatccagttgagcgtgtattagtaggagcagttacagattatgtaacacgagctgctcaatgtgacgttatcattgctcgataa

SEQ ID NO: 1741 - DNA, 900 bp, Lactobacillus salivarius
atgggaattttgcttaatttttggttggaatctaatatcattactaaaaaagttagcactgatactaacattttcaaaaagtatatcgataacttcaattgggatgaattactttctaaagttataacaacaactattttgttattgttagtttcgttgctattttatatttttcattatattggtaagaaaattatcaaacgagcttttaaaaaaaatcgtttagttgaatcattgtcttctggaagaattaatacagcttacacattatcacaaaatatcttccattattttattttgttcttctatttttatgcggtattatctttgctaggaattccaataggttctttaattgctggtgccggaatcatgggtgttgcaataggtttaggtgctcaaggatttgttactgacgtggttactggattttttattcttttagaacaacaatttacagttggtgatgacgttaagatcgggactatttctggaaaggtagcagcttttggtttaagaacgacacaaattcttgactatgatggtactctccattacatacctaatcgaagcatcacaattgttagcaatctttcgcgtaatgatatgcgagcccaaattgatatccatgtaaagcctaatcaagattttgataaaattaagactgctatacaaaatgtaaacaaatctttaactcccaaatttgatgatattaccaaaaaaccacaaattctaggtgtagttgagactccaaatggccttgtttacagagtaattatttttactaaaaatggtgcccaagctcctgttcaaagggcatttctcgcaaaatatttagaggctttaaaacaagctggtttagagatgcccatttctcctattaatctatcagctaagtaa

SEQ ID NO: 1742 - DNA, 576 bp, Lactobacillus salivarius
atgcctaaaaatcgtatggaggcatttagtgatggagttttagcaattataattacaattatggtattggagttacatatgcctgatggtgcgacttttgacgctattaggtcaattatcccaacttttattgcatatgtgcttagttatatttacgtgggaatttactggaataaccatcatcatttagtatctacgttatcaagagtatcgggaaaaatactatggttcaatttacattggttattctggatgtcattattacctgtagcgacaaaatggttaggaacatatccttttaaaacagcaccaacctttgtttatggatttatattatttatgtgttcgatttcttactatttattacaaattgaagttttgaaacaacataagaaaaattcgaagttgaagcagttatttggtagtgactttaaaggtaaagtttctgtggcattgtatttaactattacaatttgtgccttatttttaccaattttaagttatgtcctattggttattacaactttactttggattattccagatagaagaattgagagattttataatccataa

SEQ ID NO: 1743 - DNA, 900 bp, Lactobacillus salivarius
ttgatatatgctaaagatgaaaaaaataatattgtagaagcaaatatggctaaaaaaggaagaaaatattattgttctggttgtcatgggcaagtgatattgagatgtggaaaattaagagttagtcattttgcgcataaaaagcatgcttgtgatatcttttccgaaggtgaaacatcagaacatttaagaggaaagaaattattaatgacatggttaagaaaagaaggaaaggatccacaaatagaagcatatttgacttcattacatcaaagacctgatattttgtgtaataataaagcttttgagtttcaatgttcgccaatatctgtagaaagaatgagtgaaagatctaaaggatatataagtgaaggatatgatttcttttggtttttaggtaagaggcatttgatcaaaaagagattaacacaacaaatagcacaatttatacgatggcataaaaatctaggattctacttaatttatattaatgtagaacaaagaaatatggaggtttattaccatattcaacaagctgactttttaccagtccgtttttatagaaaaaaagtaaatagctggaaggaattacaagatttctttaagcaaaatagaataaagaattataatttattgtctatatcagagagaaaacgacaaaaaaattgtttttatagaaattgtttgcaatcgacgaacaaatttaaagagttacaagtaatatgttatatccatggatatatactacaagaaatatacgaagaaatttcaagcgaaagatatacttatccaatctacaaggaatatatattcactaaaaaaatgtacgaaaagttgaatttaaaagatatagaactctattatcaattaccattcatcaattttagtaacattgattaa

SEQ ID NO: 1744 - DNA, 666 bp, Lactobacillus salivarius
ttgaagatgaatgtgttacaacactcaattcatgaaggaataggtttaattggcgaatgggcagaaaataatggatatgaagtaaacgtatatcaagctgctaataacaatgtgaagttaccagaagttattgatactgatatgttggtagtattaggtggaccgatgagtgttaatgacgacgaagaatggattgttaaggaacgagaattaattagaggaatgttgatggcacataaatcgtacttaggaatttgttttggagcgcaacaactttcaaaaactttaggcggggatgtgagttcttgccctaaagaagtaggttggggagaagtgaaacgtctaagtaatataattccggaagttccagaaaaattggatgtgctacattggcatggtgaacagtttagattaccaacagaagcaactccacttttctcgagtccacttgttgaaaatcaaggatttattattaatgaaaatgcaattggtctacaatttcatttggaaatgaatgaagcaggtgtgcgtgaagtagtagaaaatgatagtgaattcataaaaggaaataagttaaagcaaagtgctgctgatattttgaaacataaggttcctgaaatgaataagcaagcattatttgcaatgctagactatattaaagactaa

SEQ ID NO: 1745 - DNA, 1176 bp, Lactobacillus salivarius
atgcttgataacatgatttttaagcaactaatgaaacattcttttacaattccagtagaggtaacctatcctaatgggaaaactgagaaatatggtaatggtgccccacaggtaaaaattaaagttaatgaaaagataccagtaaaagatttactgagaaatgcttcaatcacattaggtgaagcatatatggataagaaaatagaagtaagtggttctttacaagtgcttattaattcagcatatgaatcagcaaacagtttcttgaataataataagtttaaacgtttcttaccaaaacaatcacattctgaagaaagtagtaagaatgatgttcaaagtcattatgatttgggaaatgacttctataaattatggcttgataaaactatgacatattcatgtgcttattttgaaaagccagatgattctttagaagaagcccaaatgaataaagttcatcatatcttaaagaaattagatccaaaaccaggttctagtttattagatattggttgtggttggggaacattaatgttaactgccgcaagggaatataatatgaatgttgttggtattactttaagtgaagaacagtataatgcagttaaacaacgtattaaagatgaaggattggaagatcaagctgaggtacttcttgaagactaccgtgaacttgatcatctaccatttgactacattacaagtgttggtatgtttgaacatgttggtgaagaaaatctaggtgaatacttcaatacaatttcaagatatttgaagagtaatggggtagcattgattcatggtattactcgtcaacaaggcggagcatataatggttggattaataaatacatttttccaggtggctacgtaccaggtctaaatgaaaatctaactcacattattgaatctggtatgcaagttgctgatatagaaatgttgcgtcgtcattatcaaagaactttggaaatgtggacagataatttccataaagtattgccagaagtaagaaagatgcacgacgaaagatttattcgtatgtgggatttatatcttcaagcttgtgcagcttcatttgaatcaggaaatattgatgtaatccaatacttgatttctaaaggtccaagtgctcgtactttaccaatgacaagagattatatgtataaagattaa

SEQ ID NO: 1746 - DNA, 633 bp, Lactobacillus salivarius
atggttgaaacaataacaattcctgaaataaaagtcatggctgaattaataacgaatatgaaacataagagggtaggaatattaggtggtacttttaatccaccacatctaggacatttaattattgcagaacaagtaaaaagccaattaaatttagatgaagtaatgtttatccctgattaccaaccacctcatattgataaaaaaacagctatttctgctgaaaagcgactaaaaatggtgaaacttagtacgatggatgagcctggatttaaagttagtgatatagagttacgacgtaaaggtgtaagttatacaatagacacaattaaggaattgaaattgaagaatccagaagtagactattattttataattggtggagatatggttgagtatctaccaaaatggcatagaatagaagaactaattaaattagtaaaatttgttggtgttggtagacctggatatagaaagaaaagtaaatatccaattatgtgggtagatgttccaatgacagatatcagttcaactttagttagacgaaatgtaaagcaaggatgttctataaaatatttagtgacaccagaagtggaaaactatatacatgaagaaggtttgtatcgtgaataa

SEQ ID NO: 1747 - DNA, 1203 bp, Lactobacillus salivarius
gtgcaggatagacagtcgcgagaacgtcgtgaagaagaagacgcacgaatagattggggaattattctatctgttatggttcttgcaataataggaatgctttcaatttatgttgctgcaagtcatgacactagtacaatgagtgtaccaagaacacttatttctcaagctatgtggtatgcaatagggataggtgcaattatatttattatgcagtttgatgctgaacaattgtggaaagtagctcctattgcgtatggtttaggtattactttgttagttttggttttgattttttatagtagagcttatgctttaaagactggggctaagagttggttagctttcggacctttgacttttcaaccgtctgaagtgatgaaacctgcctatattttgatgttaggtagggtggttgcacagcataatgcagagttttatgaacacactattaaaacagattggaatttgataggaaagttggctctatggacattaccggttgctgtattgttgaaattacaaaatgacttcggtacaatgttagttttctttgctattctcagtggtgtgattttagtttcaggtgtttcttggaagatattagcgcctctttttggaggtgctgccttcttaggaactgcaggtattttattagctgtttatgggagaaatttattaatggcaataggtttcaaagcttatcaatttgctagaattgaagcttggttgaacccatctgcatccactacgggtaatagttatcaattatggcaaagtatgaaagctattggatcaggacagttatttggtactggatttaatcattctaatgtatatgttcctgttagagaatcggatatgatattttctgttataggtgaaaattttggattcattggtggatgcattttgatttttatatatctattacttatttttcaaatgattcaggttacctttgatactagaaatgaattttatgcgtatatttctacaggtgttattatgatgatcttattccacgtttttgaaaatattggtatgagtattggattattaccattaacaggtattcctctaccatttataagccaaggtggatctgctttaattgcaaacatgataggtataggattaataatgtctatgagataccataataagagctatatgtttagcagtagtaaggaatttcgttaa

SEQ ID NO: 1748 - DNA, 927 bp, Lactobacillus salivarius
atgtttttaggaaggaaatttttatccatggaaaataaaaagaagttttggacgataatgattattatttcctgtactttctggggaatatctggaatttttgctaaattcatttttaacctggatagaagtaatacacctatatttgtaagtcaaataagaatgattataagtggtttagtgatactatttttcagttggttaaataaggataagcctatggaaatttggaaaactaaaaaaagtagttttacaattattatgtttggactattaggtttaattccagttcaatactgttattttgaagcaataaaatatggtgatgcttcaatagctactattcttcaatttataggtcctttttttatactgttttacttaacaattgtaaaacgtcaagcacctagaagaattgaagttatttgtacgattattgcatttattggtgtatttattcttgctacacatggaaatataaatcatttagcaataactccacaagttttgttttgggggcttttgtcagcgattggagtagctactaatactctgattcccaagtcattaattcatgaattttctccaactgccgtcacaggctggggattactaattgcaggagttggattgtttattatccatcctcacgttagtgctagcattttagcaccacaagctattgtgccattattatgtgtattagtaattggaacaattattccatttcaattatttactagtgctttacgctatgttaaggcaacaactgcaagtatgttagatgcctttgaacctatttcagccacaattggttctattttagtttttaatatgcatttctatttagctgatatgataggttcagttctaataattttggctgttatcttattaaactggcaaccaaaaggaaaaatccagtaa

SEQ ID NO: 1749 - DNA, 834 bp, Lactobacillus salivarius
atgtataaattagtagcgattgatatggatgaaactttattgaatgatgacgctgaaattacgcctaaaaatgtatccgttctcaaaaaagcgattaaagacggagtaaaggtggttttaaatacaggtcgaagctatctttctgttcaagaaaatttgaagacattaggaatttaccaaactaaagatcaatatgtagttagttttaatggtggagcgattgttgaaaataaagatttaaaggtggtacatgttgaaggattggcctttgatattgttaaacaattgtttgatatcagtttgagatattatcctgaaagctgtatccacgtttatactttggatgaattgtacatgtggaatgtcaatcaagacgaaaaagattacttgcaaccacgtggagtagagtggactgaattgcaagaacctaatattgatttcttaaaagacactcctattactaagattattatcaatattaatgatatggataagagacttgcctttaatgagattgcacgtaaagaaattggcgataagttcaagaccacatattcttcaggtcgttatattgaattcaataacatttcaacggataaaggtacagggatgttgaaattagctgaaatgttaggaattaagccagaagaaacaattgcaattggtgataatagtaatgacttaccaatgattgaagctgccggagtaggtgtagctgttagaaatgctaatgaacaagttttatctaaagcagattatattcgcaagcgagataataatcatgatgccgttgctgaagcagtggataaatttatttataataaaatagattaa

SEQ ID NO: 1750 - DNA, 765 bp, Lactobacillus salivarius
gtgaacttaatggaaaaaataataacaactaaagatgtacatttatattatggaagtaaggaagctcttaaggggataactttggactttccagataaggggatacatgcattaattggaccatctggttgtgggaaatcaacgtacttaagaactttaaatcgaatgaatgacatgatagaaaatgtaaaaatagaaggcgaatttaaatttaagaatcaagatatatatgatgaaaaaatagatttggttgaattaagaaagaaaataggtatggttttccaacaacctaatccttttccattttctatttacgataatgttacttatggattaaggatggctggtataaaagataagagaattttggatgaaaaagtagaaacaagtttgaaacaagctgcaatttgggaagaagtaaaggataatttaaataaaaatgccttggctttatccgggggacaacagcaaagaatctgtattgctagggtacttgctgtagctccagaggttattttactagatgagccaacaagtgcgcttgatccgatttcaacagaaaaaatagaagagatgttactaacccttagagataattatacatgtataatggtaacacataatatgcaacaagcttcaagaatatcagatacaacgtctttctttttaagtggtaatttagttgagagtaataaaactaaaaagatatttttaaatccagataaagaacaaacagctgactatttaagtggaaaatttggataa

SEQ ID NO: 1751 - DNA, 1389 bp, Unknown
  Description of Unknown: sequence from a bacterial species not precisely identified
atacctctgatagtcatatctgccgaccgccccgctgaaatcatagaccagggagccgggcaaacgatacgtcagcacggagtattgtccgcacatacggcatacagtacatcgctgcgcgaagggaccgatgagaagacgctcagatacaacgcccgcgagataaacactgcgttcgacaaagccgtagccgaaagcgccccggtacatataaacgtgccgttttccgaaccgttatacggcacatcgtccgtaacggcgttcggagattaccaggaaatagaaacgttaccggtggaaaatactctctcccaaagggcaaaggacgagataagccgcatatggaacgatgcagaaaaaaggatgatacttgtaggcgttcataagcccgacaaacgcctcgaaagccttttgatgagtatttcccgtcaaagcggagccgcagtactgtgcgaaacgacatcgaacctgcatggcgaatgcttcgtagaaaagatagaccaggctattatcccgtccggacaggatacattgcgcgaactggctccggaattgctcataacggcaggaggaatggtcgtatcgaaaaaaatcaaggccatattgtcgtccatgagccctaaataccacattcacgtgaacatgtacgatttcccggatacattcggatgcctgacacacaaggcacaggtgagcgactgcgtttttttcagccatattgcctctcttgagtccgaaaatacgggatactccggaaaatgggacggaataaaagccgaaagggacgtaaaacaccgtgaatacctctcgcacgtgccgttttccgaccttaaagtatgggaaatgctgacctcgcacatcccggaaaatacgacccttgaaatatccaacagcgcgtcgatacgctacagccaacttttttcgctgccatcgggaatttccgtatcgtgcaaccgtggaaccagcggcatagacggatgtacgagtacagctgcaggggttgcggcggcatctcaaaatcctgtcacactgataacaggagatcttagcttcatgtatgacaacaatgctctgtggaacgattacctgccttcgtcatttcgtatgatagtcataaacaaccacggcggaggcatattccgcatactcgacggctcacgtaaagccgatgaatgcggacgctttctggaagcgcgccacgagctcagcgtgaaatacctggcagaaatgcattcaatagaatatgcgatggcaaacgacgaaaagaacttaaaagaaaccttggctactttctggggcgaatcgcaaaaagcgcgcatactggaagttttcaccccggcggatatcaacggggatatattgaggggctactttgaatatttaaaataa

SEQ ID NO: 1752 - DNA, 1086 bp, Unknown
  Description of Unknown: sequence from a bacterial species not precisely identified
ttgattatttttgcggatatgaccactataaaagaacacttggaggctgccgtagaaaacctcatgcgccttatcgaaataccttccttctccgggcaggaaagaggtacggcggaatatattttctcgcatttggtctccaggggaatatcggcatcgagggtgcgcaacaacgtatgggcagcgaatgaatatttcgatgcggcaaaacccaccctgttgttgtgttcgcatcacgatacggtgcgcccggcatcgggatatacgctggatccgcatttggctgtagttaaggatggccgcatttacggtttgggtagcaacgatgccggagcttctctggtgtcgctggcggaagcgttcgtctgtttttacagccggaaagacatgaaatacaaccttgtgttctccgctgtggcagaggaggaatgttcgggtgaaaacggtgtttcggcccttttgcctcatttgcctgcaatagactgcgctgtagtgggcgagcctacggggatgcggatggcggtggccgaaaaatcgctgatagtggtcgactgcacggcgcacggacgcagcggacatgccgcgcgcgatgaaggggaaaatgcgatttacaaggcggtaaaggatatcggggctataagagattaccgtttcccgagagtgtcggaaatgcttggtccggtaaaaatgacggtgactatggtgtcggccgggacgcagcacaatgtcatacccgataagtgcgagtttacggtggatatacgcaccacggacgcctataccaacgaagagatagtggagacgctctcaggactcgtagggtcgcaggtgcgtccgaggaatatgaaacgccgcgcttcgtctattgcggcggaccatcctctggtggcggcgggtcgcagcctggggttggagactttcggttcaccgacactttccgaccaggcattgttgtcctgtccgtcggtaaagataggtccgggcgagtcggcgcgttcgcacacggcagacgaatatgtgcttgtgcaggagatagaagacggcatacggacgtacctcaagctgttggaaaaactggtgtcgtag

SEQ ID NO: 1753 - DNA, 900 bp, Unknown
  Description of Unknown: sequence from a bacterial species not precisely identified
atggaaagaagtaaacttcgtgcgtggacggatgcgctgagattgcgtaccctgcctctgtcgtgggccggagtgataacggcagcgggacttggagccgaacgcggatgtttcagttggggtatattcgtgttgatgatgcttacggccagtttgctccagatactttccaatatggccaacgactacggcgactttgtgaaggggacggataatgaatcgcgtgtggggccggcaagagccttgcagaagggcgagataagccgcagtgaactcttactcggcatatgcgttgtctgcggcgcggcaatggtgtcgggcctggcgttggttctggcggctttcgggttcaagggactgggatatgtggcgttgttcctcgctttgggtgctttgtgcatttgggcggcggtaaaatataccgttggacggactgcatacggttacgtcggacttggtgacgcggcggtgttcgtgtttttcggactggtgcctgttgcaggcggaatgttcctgtacacggggcgtttcgatgctctgtcgctgatgcctgcgtcggcaataggactgctgtcgaccggcgtgctgaacctgaacaatatgcgcgacaaggacaacgatatcagaagcggaaaacgcactctggcctccagaatgaatatgtggcagggtaaactgtaccagagcgcgctgatacttgcggctatggcgttggtggcaggttaccagttttcggtttaccgcacattgctgtggtatctgcctgccgcgttgtgccttttgaatataccgctgttgcttcaggtgaaaaaaagggaagagttcgacgggttgctgaaagtattgtctatatcgacgtttttcctgtcggtggttctggcggttgccgtaaatatctaa

SEQ ID NO: 1754 - DNA, 1140 bp, Unknown
  Description of Unknown: sequence from a bacterial species not precisely identified
atgctggctctgtgggcatttgtccttatgagcctcgtgtctttcgctcaggaaaacctcgtagccaaaaccagtcagggcgacgaggcggcgaaggaaaaattccagttcgcagtagataagaaattgcctgccacggacgtcaaaaaccaggctaaatcgtccacgtgctggtcatattccggcctttcgctcatcgaatcggaaatgttgcgcatgggtaagaaaccagccgaccttgccgagatgttcgtagtgtacaaagtgtaccaggacaaagccgacaaatacgtgcgcctgcacgggaacctcacattcgctccaggggcggaaggctccgacgtgttcgacgtgatacgcaaatacggaatagtcccccaggaagtgtatgaaggacttattcccggcgaaaccacgaacaaccataacgaaatggataaaaagctgtccgaatacgttaaggaggtagcttcgtccaaagtcatacgcggggattggaaaaaaggtttcgacggcatactcgacgcttatctcggttccctgcctcaggagtttacttatcaggggaaaaaatacaccccgcgcacatttgccgacgaagtggtgggtataaaccccgacgattatatttacatcacctcgtgggcctgtgagccgtattatgaaaaaatacaacttctcgtaccggacaactgggcatgggaaaagttttataacatacctctggacgatatgatgcgtacgatagaccacgcgctggacaacggttacaccatactgtgggcggccgacgtgtccgaaaaaggattttcgtcaaaactgggcgtaggggtagtgcctcagatagaagccgaggacatgctcgacggccctaaaccggagaaagaaataaccgaacagatgcgccagcaggcattcgacgattataccacacaggatgaccacggaatgcacataataggtacggcgaaagaccagaacggtaaaaaatactatctggtgaaaaattcctggggtaccgaacgcggacgcgacggcggcatggtatatgtgagcgaggcttacgtgcgctacaaaaccacgtcgataatattgcataaggacggtgttccggacgacataactaaaaaactcaaataa

SEQ ID NO: 1755 - DNA, 1110 bp, Unknown
  Description of Unknown: sequence from a bacterial species not precisely identified
gccgctgtaaattcttcgccttcggtcatcaggacgcacgcagcccgtgccgatgtcaacgttccgacaggcaacaagacatattctcttgcttccaggctcactatcacagggaacacggaactggaggtacttaacggtatattgtatgctcaggatctcacgcttggccagggggcttccgtatcgggcgacggccgtgtggttttgtcaggaaaactgggagttatgaaagatgcggctgcagagatagtttccggcatggtaatcagcgcggatgtactgtgcagtaacggcaatctgacaaacggcggcacgttgtactacggaaaatcaaccggagccaataccccggtttcggccgttgccaaatccgatgcgcagctcgcaaattcggcgttcgactactggtacaccaagaacagtactgttctggtaggattggagtctatgaccgatgcccagaatatatggggcagcggcaatggaagcgcaacgaaaaaaggtttatctaccttgggagaaaatcctacgatggaggaaactacgaatgttgtaaatgggaaagccgtgaaaatgataagcaaatggataggcggttttggaaataagtttgcggccggaaatatttttacaggcgtttataccaaaaccaacatctatcctccgggagcggaaatgactttcggagttcctttcggttataaaccggtagctatttccggatattacgattatatctcaggggctatagactatgttgacaataaatcaaatacgccgggtacatacgataaatgtgatatatacattgttctgtgtaccggaacttattcgattgttacaacaaatgccgattcgtatcctggcggggccgtcagcgatttggtcaacgattccaaagttctggcatacggtcgatttaccgatgccgccaccaccaacggatataagaaattccgtgtggaactgacgtataaaaactccgatttcaattctgctgaggctacgcatatactcatatgcgctaccagcagcgtggacggcggagcttttacgggcagtacttccagcgtgctttacctggatgaggtgacgctcgaatattga

SEQ ID NO: 1756 - DNA, 1005 bp, Unknown
  Description of Unknown: sequence from a bacterial species not precisely identified
ttgcctcaggggctaaaaaggcttacttttgcttttaagaaaaacaaaagatacatacagatgaacaacaccgaagaaaaagcaaaggtactcatcataggttccggacctgcaggatacaccgccgccatatacgcagcccgcgcagacctctcgccggtactgtacacaggcatgcagttcgggggacagctgacacagaccaccgacgtcgaaaactttccaggctttcccgaaggcatagacggcaatatgcttatgagccagatggaacaacaggcacgcaatttcaacaccgacatacgtatgggggctgtcactgacgtggacttttcaaaagagcccggaggctggcacacggtaaccgtggatggcgagaaaaaaatccaggcacgtaccgtcataatagcaacaggagcatcggcacgatggctcggcatacctacggaacagaaataccggggcttcggcgtatcggcctgcgccacctgcgacggcttctttttcaaaggcatggacgtggcagttgtaggcggcggggattcggctctcgaagaagcctcgtacctggcaaaaatatgtcccaaagtgtacctgatcgtacgacgcgaccagttccgcgcatccaaagccatgcaagcccgcgttcttgccaccgaaaacatcgaagtggtgtggaacagccaaattgacgaaatatacggtgctgaggccgttgacggcataaaagtaaaaaactccgtttcaggcgacatcagggacattcccctctccggagtattcgtagccattggacaccatccgaacacggacctgttcaaagacaaaatggagcttacgcccgaaggttacatcgtaacaaaggacgacacatctattacgagcgtacccggggttttcgccgcaggcgacgttcgcgacacccgttaccgccaggcgataacctcagccggatcgggatgcaaagccgcaatggacgccgaaaaatacatagctgaactgtaa

SEQ ID NO: 1757 - DNA, 1797 bp, Unknown
  Description of Unknown: sequence from a bacterial species not precisely identified
atgaacacagcacgccgcacaaaaagcaatgccttatatatattactcttcctacagatattctgttctgcgggcgcgactgcgcaaacggtaaacaacaacaataattacaacaacagaaaccggactgaaatatacgatccttacaaaggcaagaacggcgaacgcctcaacgctttcggcgagcctatactggacggcaaagaacaggaaaaacaggactcggtagatgccgcacgcggcagaacccgcgaccgcaccgtataccgcaaccgttataaggactccatacaagtttacaagataatatcccccacgtgggacactacgcttgtagacacatcgctcaacatatccaagttatacaaactcaaccctctacgcaaggacgaatacggatacatgccgtttcctaccattgcccagggatacacgcctatggtgctcgacctgaaaccctcgctcacaccgagctacggcataagttccagaagcatgtactaccgcaatgccgacgagataaactactacgacgtgcgcactccatggtcggaagccatgtactatacgaacgtattttccaacatggagagccatgtgctcgatttcaacttcacggccaacgccggcaggctgttcaacttctcgataggataccggggcaaacgcactaaagagggactttacaattacacaagcaaccaacacggacaactggtcggcacattcagttttcacgacaaaccgtaccggtacatactgcgcgggcacgtgacataccagttcctctcggcaaacgaaaacggcggactgacagccgaagggatggaaatgttccgctcgaacgacaaagaatattcttaccggacgacattgcctgtcaatctgtccggttcggatgcagcagtagccaaccgtcttggcggaacgaggttttacgtgagccaatcctacgacctgttcaactcgtcggttaaaaatccgaaaggcttccgcataagccttctgaacgaaatacaataccaacacctgacatacaggtactacgatccggcattcaaagaccctgacagcaatacaggcgaaaaatcgataaattattacaggtcggcggtacttcccgaagctcccagggtggacagttcgtatttcaacaccctggacatagccgcaggcgccggcgtcaatttccctctggtcaacatttacgcccagggcatgatacgctaccagtcttccacatacgcgttccaggattctctggcctacggcacgggcatggacaacagagagaaaatatccggcaacacaatatccgtcaatcttttgggacgttggaggccgatgcgttatttcggtgccgacgcttcgttcgattacagcctttccggagtgttttccgatgcccgcatactgaaactctcggcatatgctcagctcaacccgcagaacaggctggaaggctcatacatgaacgcttcttactacgcgccgctcgtagcgcggtactaccgcagttcgttcgccatgttcaactggaagaacgatttcaaaaggatagaggcaaacgaaatagccgttacgctcaaaagcgacaagataatcaatgcgcaggtgaaatttacggacataagcaattacgtgtacttcgattcgctgcgcaccccgcgtcaatttgacgacaaggtaaacgtactgtcggttaccgtttcccgcgacacccgcatcaggtggttcggatgggacaacacggtaacctaccagaacgtaagttccggggcgtccgtgatgccactg

SEQ ID NO: 1758 - DNA, 1059 bp, Unknown
  Description of Unknown: sequence from a bacterial species not precisely identified
atgaaaataccttaccgcatttccattttggctgtgacagcgttgttcgcggcgtgttcgggcggcggaaaagaaacagcgccgggcttttccgaacctgcagccctgacagccgacagcataaccatcagccagataatagaccctttccagtggacgtccgtcggcggacattgcgtaatactgggcaaaagcacagaaaaagcactccatgtgtacagtttccctgacttcgaataccgttacagcgcactcacacgaggccaggggccgggagaactggggccttacgcttttataatccccggcgacgtttcttcaggcaggttattcctgcacgaacggctgacaagtaacgccctgagcgaattttccgtatcggacacggaattgagcctatgcggcgaaccggcaatacaaaaaggaagcctgatatgtgtcacgcaggatacgctcgtggtgaaagagaaaaaaaggtacaaggaagaaaaatgttataccaccctcgaatcgacggaacatccgggtatggaactcgattcgatggtcaattacaacatttacaaaataaaagaatcggcaaattctatcagcatatttaaaatgaacgcgccgttctatctgtgcaaagacgacaccctcgtaatggcttacaaagacacccgccgcttggatttttcggatatttctaaagggaagttcaaaacgttcaaaactttaggggataactcgacgctgaaagaactcgaatcgcgcattaccgatatgggcaacgggatgtggtcattcggaggccaaggggaatttttcgccgccgccgatgcatctgccgactacatatacgtacttctgtgcagatattccccggaacaccctgacgatatgtctaaaaaatcctcttccgtactcgtgtacgactggaaaggaaacgaagtgcgcaggttcgatctcgacaaatacgtcaacatgatggtagccgacagaaaaacaggcaatttattctgctacgacagcgcattggatttcgaacgagtgtacgtgtaccgtcctaatatatga

SEQ ID NO: 1759 - DNA, 1236 bp, Unknown
  Description of Unknown: sequence from a bacterial species not precisely identified
atgtcttctttcaaggaaataacatcgatggcctgggacaacgtacgttcgcagcgcctgcgcacgggtataaccgcaagcataatagccataggcatcaccgcgctcgtaggcatcctaaccagcgtatccgctcttcgcagctccatggtggacagtttcaaatcgttcggagccaacaccgtaggcatatacggcggccgatgggcgccaaaggaaaacgatcccaacgactgggtattcctcccaaggatagactaccaccaggcgcgcgaattcaaaaccaaaatgggtaaaaaagccgtcatatccatcaacggaaccgtaagcggcaacgccgaaataaaaagcgaaacagccaaaaccgaccctaattcccgcgtggtaggcgccgatgaaaactatttcgacgtagaaggcttcaaaataggcgaaggccgtttcttcacctccgacgaaacggaaaccgctcccaaaatcgccgtaataggcgtcgacatagcaaaaaaactgttcccttcgggcaaatcattgggccagtacatcagcatcgcaggcaaccgttacaggataatcggcgtgatgcaaagccgtggatccatgatgggtatgagccaggataacgtagtgttcctgcctctgaatacggcaaggagcaattttccacgtttcaccaacttttccgtattagtcaccccgcctgaaggcacctccattaccgataccgacttcaacgacgacatgcgcgtgaccatgcgcgtagtgcgctccctccacccttcccaggaagacaatttcatgatacgcaaccgccaggccgctctcgaccagatggaaggcatgctgtcaaagctcaaaatagccgcccttgtcataggactcataacgatactcggctcctctatagcccttatgaacataatgctcgtatccgtaacggaacgcacacgcgagattggcacgcttaaagccataggcgcaaactcgcgcagcgttaccttgcaattccttatcgaagccgtaatgataggccagataggaggtatcatcggcattttcatgggaatacttttgggcaatatcgtatctctggccatgaagaccagtttcgtcctgcctttgcgcgaaatgttgatggcatttgccataacgttcgccgtaggcatcatatcggggtactatcctgccaaaaaagcctcgcgactggatccgatagaagccctccggtacgaataa

SEQ ID NO: 1760 - DNA, 780 bp, Unknown
  Description of Unknown: sequence from a bacterial species not precisely identified
ggacaaaatgacatcgagaaaatacgccgccgcacggcagccttccgccccgacagggtgttttcgataggcggtgacggcactttccgcacgatatgttcggcaatcaagggaatgggtatcccggtagcctacatcccgctcggttcggctaacggcatgagggaggatctgccgtccggcgattcgccgtgggaaagtttcgagatgctcatggccacgtattataccagacagctggatgtgataacgataaacggccaggattgcatacatgtggccgatgtaggcataaatgcccagttggtaaaggcgtacgaccaggacaagaaccgcggtatactcacctatgccaaatacttgttcggagctgttcgggcccaggagcgctaccgcttccatataacggtggacggggttaaatacgaaaagaaaggatgcatgctggccattgccaacggtacgcgttacgggtcggggcttacattcaacctgaaaggcaatcctttcgacgacaaattcgagataatagtcgtgggacgcataaatctgggtacgcttatccgtgccgggtggtcgaagttctacgacgaagtgcgctatgaaaattattccagtatatccggacgtgaggcgcagataagtatttcgcgccagactaccctgcagatagacggggaaataggcggccggttcgataccctggacatccgtatgtcttcagaaaaagttcccgtgctgatatgccgcacccctcagcagggtgcgggccgtaaatga

SEQ ID NO: 1761 - DNA, 1173 bp, Unknown
  Description of Unknown: sequence from a bacterial species not precisely identified
atgagaaagatcacaatactcgcgtttttcgccgcattgccggcaataatggctgcccagacgcatcataacacgatagaaggcaatgtggaaggactggaaaaaggcgaccgcataatcctgtacacgggcaccctgacccaaacgccaatagccacagacagcactatcgtaaagaccaccggtaagttcacattgaaaacggccgcttcggacacttatgcgcagattgcatttttcaaaccggggcaaaaagcagacatcaaccaggttgagacttcaggactatttctcgaaggatacgataaaattaaactgaacggaaaaacatcggattggagatatcttaaaatttcgggagggctttactcattaccgcaaatgcaagaaataaacgccctgaccgaaaaagcgctggaaatgcagaaacaaggaatagcgcttctgggcaaaacacgcacggaaggagccgataaggacagcgtgaaagcatggagcgacaaaggccgcgcactgctcggaaaatccggtgagatattcgaccaaagaaaggccctggaaaaaaagatatccgcagacaaccccgacctggcttacagcgccgaaattctgcactacgattacgaccttatgaaaaaaggcatggacaaatacgaagaagctttcaatgccctgtcgccacgcgtacagaaatgtcccgccggacaggtgttggccgacttcatagccacgcaaaaagccaccgcgataggggcggaagccccggacttttcactggaagatatcgacggcaacatgctgcgcctctcggacttccgcggcaaatacgtactgctggatttctgggggacatggtgcgggccgtgccggcagtccactccacatcttgtcgaactgtattcaaaagtaaaaggccgtaattttgaaatgataagcatagccaccaacgaaagaagcgatgactactggcgcaaaatagtatccgacgacaagatgacatggcggcagcttaatgatgcccacagcccggccaatggcaaaatacaacagacatacggagttatgggcgtaccgtcgtgctttttcatagacccgcacggagtgataatagccaaaggacatccgatgagcctgttgaaaaaagtggaagaagtcataacagctcccaaataa

SEQ ID NO: 1762 - DNA, 834 bp, Unknown
  Description of Unknown: sequence from a bacterial species not precisely identified
atgaaaaagacagcaacggtaataatattgacgctggcagttatagtagccggtgtagtaatagccctgaaatacaattccggagcatgcgattacgagtatacgatactcagccgcaattaccaggattgtgccgattcttcgaactgtacgtcgatttatcttggctatccggtattcgggcgtaaactgtttaacgaccgtgcgatagacagtatcaacagacatgtggccatacaagtgaccggctcggcggaaaaaacggccgaagatgttgtttccgaattttttgaaggctatgcccagtatgcaaaagaccgtgccgagatgaacgcacaggatagtatagccgatggttttattccttcgtggacgtattcttcggactgttcggttatggttaacgggcctcagattatcgttaccgaaatgaagttcaaccagtatgagggcggggctcacggtatttacgccaatatttatacgaattacgatgtgaaatccggccgtgcgcttggccttaccgacgtattttccgatacggtggctctggcacgtacgctgacagagtgcttcatcgcacagaaagaacttgacgcttctgttccgcttttggagcagggatatttcatagacaacaatcagctgcctgtcacggccaatttcgcccttacccctgacggtgtgatattctattacaacgtgtacgagatagcgccttatgcatacgggccttcacaagtgaccgtaccttatgccgatttgaaggatatcatggtttataaacccgatttctccggttccgaggttttccctgtcgaatccgcttcataa

SEQ ID NO: 1763 - DNA, 522 bp, Unknown
  Description of Unknown: sequence from a bacterial species not precisely identified
ccgggccgactgcgcgactggatatccacacccaaatctaccgggtacgaagccctgcacaccacggttatggggcccgaaaaccggtgggtagaggtgcagatacgctccgaacgcatgaacgaactggcggaaaaaggctacgccgcacactacaagtacaaacatgcaggagaagcctccgacagctacatggacgaatggatagccaaagtacgcgacaccctggaacaggccgaggtaaacgccgccgacctggtcaacgaattcaaactcaatcttctggtgggcgaaatattcgttttcaccccgaaaggcgacctgcgcagcctacccaaaggcgctactgcactcgatttcgcatttgccatacacagcgccataggcagcaaatgcctgggggctaaggtcaacggcactctggttccccttaactacatactccaaagcggcgaccaggtggagataatcaccggcaaaaaccagaaaccgaaagcccagtggctcgaattcgtcaaaacc

SEQ ID NO: 1764 - DNA, 1224 bp, Unknown
  Description of Unknown: sequence from a bacterial species not precisely identified
atggaaatcccttctaagtacagtccgcaggaaatagaggacaaatggtacgcctactggatgcagaacggttactttcactcggaacccgacagccgccgcaagccgtacaccgtcgtcataccccctccgaacgtcacgggtgtgctgcatatgggacacatgatgaacaatacgatacaggaccttctggtgcgccgggcccgcatgaaaggcttcaacgcctgctgggttccgggaaccgaccacgcgtcgatagccaccgaggccaaggtagttgccaggcttaaaagccagggtataaacaaatccgacctctcgcgcgaggagttcctgagccacgcatgggactggacgcacgaacacggaggcataatactccagcaactcaaaaaactcggcgcatcgtgcgactggcagcgcaccaaattcacaatggacgacgacatgtcgcgctcggtcaccaaagttttcgccgacctataccgcaaaggacttatataccgtggataccgcatggtcaattgggaccccgaagccctgacaacggtatcggacgaagaagtgatatatatcgaacagcagggtaagttgtactacctgaggtatatggtggaaggaaccgacgattacgtagtcgttgccaccacccgtccggaaacgatattcggcgacacggccatgtgcatcaacccggccgacccccgttatgcccacatacgcggaaaacgcgtcatcgtacccatagccggtcgcgcgataccggtcatagaagacgaatacgtggacatcgaattcggaaccggctgcctgaaagtaaccccggcgcacgacgttaacgacaagatgttgggcgacaaatacggactggatgttatcgacatattcaacgacaacgccacgctcaacgcctacggcctgcactatcagggcaaagaccgttttcaggtgcgccgcgaaatagaaaaggaactggcggaaaaaggacttctggaaaaagtagaaaactacacgaacaaagtgggcacatcggagcgcacgaaagcggtcatcgaaccgaaagtatcgctccagtggttcctcaaaatggaaaagctcgccactccggcgcttaaagccgtgatggaggacgaaatacgcttcgtaccggaaaaattcaggaacacgtaccgccactggatggaaaacgtccacgactggagcatctcgcgtcagctgtggtgg

SEQ ID NO: 1765 - DNA, 1077 bp, Unknown
  Description of Unknown: sequence from a bacterial species not precisely identified
atgttcgacttttcaatagtaacaagctggatagacaccactctgagggacctgatgccgtcgtggctggcccttaccgtggaattcgtccttatcggagtggccatactgctgctttacgccgtgctggcgcttatcctgatatacatggagcgccgtgtctgcggagcgttccagtgtcgtctgggaccgaaccgtgtgggaccgaagggcgtgatacagtccgtggcggatatgataaaaatgctcataaaggaacttatcacgatagaccgttcggaccgtttcctgtttattttggctccgtttatcgtaataatggcctctgtgttggcattcagcatgctgccgttcggccgcgggcttcaggtactcgatttcaacgtgggtattttcttcctgttggcggtttcggctatgggtgttttgggtatccttttggccggttgggcttccaacaataaatattcccttatcggagcgatgcgaagcggcgctcagatgataagctatgaattgtcgataggcatatcggtgcttacgatagttatgttcgccggttcgatgcagctttccacaatagtcgaaggccaggccgacggatggtttatattccgcggacacataccggccctgatagcttttgtgatatatcttatagccggtaatgcggaaaccaaccgcggaccgttcgaccttccggaggctgagagcgagcttaccgcaggttaccatacggaatactccggcatacagttcggatttttctacctggccgaatacctcaacctgttcattgttgccgctgtggcttcgactttgttcctgggagggtggatgccgttgcacataccaggcctggatgcgttcaatgccgttatggattacataccttcggtggtgtggttcttcggtaagacgttcttcatgatattcgtgctgatgtggttcaagtggacgttcccgcgcctgcgtgtggaccagatacttgcgctggaatggaaataccttctgccgataggtcttttcaacctgatgctgatggctgtggtggtgatattcggcctgcatttctaa

SEQ ID NO: 1766 - DNA, 396 bp, Unknown
  Description of Unknown: sequence from a bacterial species not precisely identified
atggcatcgattagaaaaactgcggcttcttttatgggaggcatggtgctttttaccatggcgttttgcggggcgtggtattttctggtcccggatcatgtggatgtgttttacaacccgtggggattgtgcgctttggttacgctcgtattcatgctgtcttttctggcggggatacccggagccgatggcggcggatataaaaatcttcttcgttatctcggcggggcaatgatacgtaccgcaggcataatggcggtggtgttttatcccgtgatatgccgcagggaagctttggacagtacgacggccctggtggtaagtaccatgtgtatatacggcttcgcgatgtttttgtttctcaggagcgtgtataaaaataccggaaatgggtga

SEQ ID NO: 1767 - DNA, 705 bp, Unknown
  Description of Unknown: sequence from a bacterial species not precisely identified
atgcattacaatattatgacaaaaacaatagctttcgatgccgacgatacgctttgggaaaacgaacgtttcttccgtgaggcagagaacgagttctgtcgtattatgatgcgtttcggaaaagaagaagatctgtcatcctgtcttttttcagtcgaaacggataatatgccgttgtacggctatggcataaaggcatttacactgtcgatgatagaagccgcaggaaaaatagcgggaagaatgttgacgcaagacgacacgcacgctattataaacataggcaaatcactgctgcaaaggcctgtaaaactttacgaaggagtacgcgagacactggacaggctcgcctcaggacacaaactcgtgctggcaacaaaaggagaccttttggaccaacgtcgcaaattagaaaaatccggactaggaaaatatttttcccatgtagagataatgccggcaaaaacaacggcggattacacgcatttactggaaaaacttgacattaaaccatgtgagtttacaatggtgggaaattccgtaaaatccgatatcatgccggtagtagaattaggaggatatgcagtacatataccggcggaatatacctggcaacacgaagtgccggaagaatgtttttcccatccgaaagtaaggacggtaaattctttccgtgaacttttatgcagggatagcggactgtag

SEQ ID NO: 1768 - DNA, 579 bp, Unknown
  Description of Unknown: sequence from a bacterial species not precisely identified
aaatgcgagaaaaacggacgtttcgaatattcctccggcataccgtacaccatggacgccgcgcttttctacgctccggcaggcaccaccctggaagacatcaaacgcaccgagcccaagtcactgccgatatgccttaacccaggcgaccgactgcacatcaaaggctctgccgacgacatcccaggccttgaaatatcgggcggcatttatgacaaccgcatataccgcagttattttaccggcatcagggatataatgtccagtgccgacgtttaccgcgactcgatgaaagccatcagtaacacggcatcggacataaaagacgaggaactgcgcaggaaaaactccgaaaaactccgggagctgaacaataaaatatggggcgtagtagaggactcgtaccgctacatggacggtttcgtgcgcgctcatccggacgatcctttttcatcttacgtactgggcaacataaaaggttcctattcggaaaaacaccgtgaaagcctgtacaacctgctttcggaacgtgtcaaagccacgcccaaggccaaaatcatagcctcgcaaatcgaaacc

SEQ ID NO: 1769 - DNA, 630 bp, Unknown
  Description of Unknown: sequence from a bacterial species not precisely identified
atggaagtagcagtattagacatacaaggaaagccgaccggacgcacaatagcactcgatgaatcggttttcggggttgagcccaacgaacacgccgtatggctcgacgtcaagcagtaccttgccaataaacgtcagggtacacatgcgtccaagcacagaggcctggtatcgggcagtacgcgcaagctcaagaaacagaaaggcacaggcggtgcacgtgccggcagcataaagagcccggtattccgcggtggcggacgcgtcttcggaccggaaccgcgcgactactctttcaagctgaataaaaagctcaagagactggctcgcaagagcgccctttctcagaaggtttctgaacaaaatctcattgttgttgaggattttacgttaaatgctcctaaaacaaaagattttgttaacataattgccgctttaggtttaaattctaaaaaatcgttgtttgttacggccgccggggataaaaacgtatatttgtcctcacgaaatttacagtacgcttcggttgtgccatgcacagaattaaacacttacgaaatcatcaacaacaaggctctggtggtttgcgaaggtgcattggagcaaatacaaaacaacttaagcaactaa

SEQ ID NO: 1770 - DNA, 1398 bp, Unknown
  Description of Unknown: sequence from a bacterial species not precisely identified
atgaattataacagcgtgaaatcgattatttcaagcgccgctttcacaggcgggttgttgttcctttcggcattggccgctttcatatgggccaatgtatcccctgagacttacacatggttctggtccgaaccgcataccctgaatataggcacgcatatggaaaaagtgcttgaaaacggggtcgaggtagataaagtgtcgtatttcatgagcatttcgatacgcagcctgcaactggtggttaacgatttgcttatggttatatttttcttcagtgtcggagtggagataaaacgcgaactgatagccgggaaactttcttcgttcaagaaggctatactgcctatcggggccgcattgggaggtatgatagttcctgcgttgatatactacgctctcgaccacgaaggtctggcctcgcgcggctggggaataccgatggcaacggatatagccttttctctggctgtgatctcactgttgtcgcgccgggtaccgcttagcctcaaaatattcctgatggctttggccgtggccgatgacctcggggcgataagcgtcatagcgttcttctataccgaccatttgaatatacaggctctcctgataggtcttgccggcgtacttctgttgttcatcgccaacagggccaaggtgcacggcaaaggtttttactacatagtgggtgtggtcctggtgtggagccagttcctcgaatccggagtacatgccacgatagccggcatacttaccggtttcgcattccccagcaatgtaggaatgtcgccgtccgattatgtggacaaggcgcagaaactgctcgacaaactcaaaaaacacgaggacgataaaataataaaaggcgttccctccgaagaagtagcccatgtatataccaaactcaaggctctgacatacaaggcggaaaatccgatgatggctgccgaacacagcatggcgccttacatagcgcttgtcatcatgcctatattcgcactggcaaatgccggagtcatactcggcgacatgagctttatgcaggccgtaggcactccggtcgctatgggtgtaggccttggactgctgttcggaaaaccgataggcatattcttagtcacgttcctgttcgttaaactaggcataggtaaactgcccgacggtgtgaaatggaaacagatactcggcatgggctttatagccggtatgggctttacgatgtcgatattcgtgaccgaactggctttccgcaccaacgatttgtccttgatgcagatggcttccgactatatgaacgaggccaaactcgctatattgttggcttcgttcgtggcggcagtatgcggttatgtgttccttatgatgtgctctggcaaaaaacacggggaagaatgctga

SEQ ID NO: 1771 - DNA, 1587 bp, Unknown
  Description of Unknown: sequence from a bacterial species not precisely identified
gtgaaatacatccctcaccggggtattttccttatttttacactcgcgtcggatcctgcggatgcggaaaaaaagaatatcgaaaggggatataatacaataaaaatgctcaaaaacaccctgcaacaaaagctctcgcagcgtttctcgccttcgcagatacagctgatgaacatgctcgccctgcctacggtggctttcgaacaataccttgccgacgaactggaatccaaccccgccctcgatgaaataacgtcctcccaggacgattatacccaggacgctgacaatgcggcagaacaggatactgacgaaaacgactacacacctgaagcatcatccgacgatttcgacatacaggattacatgttcgacgacgaagaccccgattacgtgccatcgtcatcctcgagcgacacgtcgggcgaccgcaattcattcattgcctcgcaaagcggacaggagtcatttacggcgcatctgctcgaacagctttcactggaaaacctttccgaacgccaaatgaccataggccgctacataatcggcaatatcgactctgacggatatctgcgcaccgacctgatgtccgtttccgacgatctggcatttaccgcctcgatggacgtttccacggaagaaataaaacaagtgctttccgttatccagagtttcgaccctcccggcgtgggcgctacctcgctacagcaatgcttgtcgatacagctatcgtccatggctccgtcacctgctgtcgacctggccaaaagaatcgtcgatgaagctttcgacgatctgggcaaaaaaaacttcgacaggctcgccgaacgtctgggatgtacacgaggacaactttcggacgcggtaaacgaaatagcgaggttgaacccgaaaccggggaacagctactcgcaaaacacatcgtccccgtcacaactccaggtaactccggactttataatccgcgtcgaagacggccaggtcgaaataaccctggcacaaggcaatactccccggttgaaaatatcgcccgaatattcagggatgctcgcacggctggacagaacggacggcaaaacccgcaaggaaaaggatacggccgcattcataaaaaacaaaatagactctgcccgctggtttatagatgccgtacgccaaagaaggaacactctgatgctgataatggaatctattgtccgccggcaaaaagaatacctgctttccggcgatgtgtccgacctgcgccctctggtacttaaggacatagcttcggacgtgggaatggacatatcgaccgtatcgcgggtagtatcgcagaaatacgctgacacgccttacggaaccatgagcctgaaaaactttttcagcgatgcggccgtaaacgaaaaaggcgaagacatatccacccgcgaggtaaaagaagccctgcgtgaaattataagttcagaagacaagaattccccgcttaccgacgaacaacttacttccatattgtcggacaaaggatacaggatagcccgccgtaccacggcaaaatacagggaaagcctaggtttccccactgcccgcctgcgcagggaactgtaa

SEQ ID NO: 1772 - DNA, 861 bp, Unknown
  Description of Unknown: sequence from a bacterial species not precisely identified
atgggaaacaagacggattgccttttatacaaggacactgccctgggctcatcggacatcacaaataaagatttaagattatccattgagcttacgctcaatggattttctttttctgtggattccatgccgcaaggcctccaccttgccgtaggcagctatactttcagatacgggcaggcatcggagcaaaggcttcttgccgcattggtaaatgtattggaaacagagcctgatatatcgcagttgacgttttctattacgcatgcgatgtttctggatactgaatttacgatgcttccatcggagttgttctcaaatgaaaaagcatccgaatacctcggttttacattgggcagggaaatagctccagagtcagcatcgtacgacgttgtggaaaaatacggcatgacatgcgtttaccgttttccgcagtcgattgtcgattatctgtcttcgcgttgcgcggcgtttgagcgcagacacagttcatcggtattcctttcgtctgccgctcctatgtcgttaggaacttccatacatgtgaatgccgattttggttttatgcaggtggccgtgttcaaggacgggatgcctgtacttgtcaatgttttcgatatcaaatcgcccgatgacttttcgtattacctgctttcggcctgcaaccagacgggaacggacgaaaaagatgccgaatttgtcttcagcggttcgccgcaggaatatataaggcaaaggaatgcgcttgcacgccattttccacgaaggaaatttgccgtgaggaaacatccggaactttttcccgatgcgttggacttcgtggcccagtacgagtattataatattttgaacggactttaa

SEQ ID NO: 1773 - DNA, 876 bp, Unknown
  Description of Unknown: sequence from a bacterial species not precisely identified
atggaatcaaagcctaaaatctttgccgcttcgggtagcctcccgcttgcggaaaagatagctcaagcgtatggcactaaactgggtaaagtagagctatcccggttttccgacggcgaatttcagccgtgttttgaagaaactgtgcgcggggcgcacgtttacctggtatgttccactcctccgccttcggacaacctcatggagctcctgctgatgatagactgcgcgaagagggcttccgcgagtaaaataatagccgtacttccttatttcggatgggcgcgtcaggaccgtaaggataagccacgcgtgccgataggagctaaaatggtggccaaaatgctggaagcggcaggcgctacgcgtatcgtgaccatggatctgcacgcggaccagatacagggcttttttgaaatgccggtggatcacctttatgcttcgtccatatttgtggattatataaaagatcttcagaaaaaaggagagataaaagacctggcggtggcttctccagatatgggaggttccaaaagggcgtattcttatgccaaatatttcggctccgacgtcgttatatgctacaaacagcgcaaaaaagccaacgttatagaaagcatgacgctcataggcgacgtggaaggcaaggacataatccttttggacgatatggtcgatacggccggaacccttaccaaggctgcggatataatgatggaccgcggggcttgcagcgtaagggcaatggtaacacatccgatactttcgggccaggcttacgagcgcatagaaaaatccggactcaaagagttgattactacggattccattgcgttaaaaaattcatcggataaaataaaagtgctatcttgcgcc

SEQ ID NO: 1774 - DNA, 1044 bp, Unknown
  Description of Unknown: sequence from a bacterial species not precisely identified
atagactccgtgagcagcctttttgaggtagatactaccaaacgccgcaaagtgtcgtttctggccgttcccgaattttcatactcggaagaggacggcttgggacttggattcacagcgcgtatgtacataaacaactacaaaccagccgtaattggaaggatcaaacgacaatcctacgtggacctttccgccgatttcacattcaaaggcaacatgtcggtatccatacgtccggtcacatatttcatgaacgaccgtctgctggtgaaaggttacttcggattggggcactacccttcaacattctgggcaattggccccgacaccaccgacgatcagagcgaagaatacgacaaacgcacaaccatactgcgtatcagcacttactgggaatggttccggaacatatacataggcgtagggctgcattacaacgactacggcgtatcagacgtaaaggaaggaggtatgctcgaacctgggaccataacaggcagctccggaacagtttcttccggtttttccctgcattacctgtacgaccggcgcgatcatcagttcgttcctttggacgggctatacctgagcgtcgacggatatttcaacgctaaattcatgggaagcagcgaaaattacacgaaatatctggtcgatatacggtattacgtcccgatagcatccacacaagtgattgcattcaatttctactcgcagatgtccaccggacatgttccgtttcaggatatggcccagttgtccaacggggtacacagccgtggatatagcaccggccggtacaatgaccgcaaccttatgtccgtacaggcggaatacaggtattacttcgggcgcttcggactggccgctttcgccagtacagccaacgtagggcctacaccattgaaagcccttaaaatggacaagccaacattcggcggcggacttcgtttcaagcccttcaaaaaccagaggatgtacttccgtgccgacataggcgtgaccacacgcggcgatacgcagatatacctcggtctggacgaa

SEQ ID NO: 1775 - DNA, 2169 bp, Unknown
  Description of Unknown: sequence from a bacterial species not precisely identified
atggcaaagaagttttccgagacgccgctcatggcgcagtacaatgcgataaaagccaaacacccggatgccacgctgcttttccgcgtaggggatttttacgagacgttcgggcaggacgcgatagaatgttccaagatactgggcatagttctgaccaagcgcggcaacggctcggcttcggaaacggcgctggcaggttttccttatcatgcgatagatacttaccttcctaaactcgttctggccggcaagcgggtggccgtgtgcgaccagttggaagaccccaaactgacgaaaaaaatagtaaagcgcggcgttacggaactgataaccccaggcgtggcgctgaacgaccaggtgctttcctcagggaaaaacaattttctgtccgcagtgcatttcggggccaaaggtgtcggattggcgtttctggacatatcgaccggagaatttctcgtatgggaaggtcctcaggggcaagccggcaaacttcttgagactttctcccctagcgaggtgcttcacgaacgccgaaacaaagtgcgtttccgcgaagtctttggcgacacataccgcacgtacatgctcgacgactgggctttttcacccaatttcggacgtgaaacactgcaaaagcatttcaggacagcatccctgaaaggtttcggcatagacaagatgcaggatgccatagctgctgccggagcagtgatgcaatacctttcggaaacggagcataaccgtatagaccacgtatcgcgtataaacaggatacaaaacgatgcgtacgtgtggttagaccgtttcactgcgcgcaatctcgaaatactctcctcgcctaacgatggggccactacattgctggatgtgatggaccgcacgctcagtcctatgggttcgcgcatgcttaaacgctggctcatgctccctcttaaggacgtacaatcaatacatgcccgtcagggcgcggtcaagtattttctttccgaggcggataaggccgacgaaatacgtcgctacgtatccggggtgtcggatatggagcgtcttgcggggaaagtggctaccgggcggataaatccaaaagaaatgactgccttgtgctcttccctcgaagtgtcaggcccgataaagaacatattgtcgtattccgggaacggacatctcaagtccctggccgaggctatggacgggtgtggcgaagtgtgttcggaaatacgccgcacgctcgcccctgaagccccgtcgcaattgtccaaaggaggtgtggtagctgaaggagtggatacggaactggacgagttgcgcgaaatgcttcactcgaacaaggcaattctcaaccgcataatagaacacgaggccgaacgcacgggcataccttcgctcaagataagtttcaataacgtgttcggttattacatcgaagtgcgcaacgcccacaaggacaaggttccgcccgaatggatacgcaagcagacgactgtttcggccgaacgctatataacgggcgaactaaaggagtttgaatccaaaatacttggggctgaagaccgtatagcgcagatagagagccgtatatattcggctttggtggaaacagtctcacggcatattgcggccatacaggaaaattcacgtgcagtagctcaggtggactgtcttttgggatttgcagctgtggcggatgaaaacagttattgctgccctgtggtggacgattcgacggacttggaaataatcgaaggccgacatccggtaatcgaaaagaaactgccggtgggtgagccttacataccgaacagtataacgctgaaccgcgacaaccagcagataataatgataaccggtccgaatatgtccggtaagtccgcgcttttgcgtcagacggcgctcatctgcctgatggcccagacgggaagttacgtgcctgctcgatcggccaggataggaattatagaccgtatatttacccgcgtgggagcgtcggacaacctttcgtcgggagaatcgacttttatggtcgagatgaacgaaacggccagtatcctgaacaacgtatcggagcggagtctgattatactggacgagataggccgcggcactagcacatacgacggtatttcgatagcgtgggctatttccgaatatttgcacgattcgcatcag

SEQ ID NO: 1776 - DNA, 1635 bp, Unknown
  Description of Unknown: Eggerthellaceae sequence
agctttatcctcgacgtcgccggctcgaccaactggcagttcatcttctacgtgaacattccgatctgcctgttcatcctggtcgcgggcctgttcaagattcccaacaccaaagaagacgaggtcaagcccatcgacggactgggcaccgcagtgctcacggtcatggtgctctcgctcatgtacggcctgaagaacatcgacttcttcgagctgtccacctcgatcacgtcgacggacgtctatccgttcctcctcgcgtttctcgtgctggttccggtcttcatcgcggccgagcatcgcgcggcagacccgatcatgaacctcgcgtacttcaaggaccgcgacatcgtcatcacgctcctgtgctcgatcaccacgggcatcatcatgatgggcacgctgttcgcgccgcagttctgcgagaacgccatgatgatgcgctcgggctccggcggctacttcctcatcatcctcggcgtgttcacaggctttggcgcaccgctttcgggcaagctcatcgacaagattggcgtcaagcccatcttggccttcgggtttctggtgtcggtcgcgggctcgctgttcatggcgttcgtgacctgcgagtatccgacgcttctcaacgtgtgcatcagcatggcgttaagcggcctgggcatcgggttcatcatgggcacgccgctcaactacatgatgctcgcaaagaccgacgagtctgagtccaactccgcgctggcgacgctttcgctcgtgcgctcgattgggacggccatcgccccggccatcatggtcgcgttcatcgcccacgcgggtcttgccatgcaggacaacatcatggaggtcctgcccaccgaggtgaccatcagcgagctgccctacgccgaggaactcgaccagcgcgtggccgacatgaaggccgacgaggacacggccgacatgctcgacggcgtggacatccccaagatgtcgtcgtacacgcacatcgagatggacatgagcgacaccgactcaaagtacgacgtgacggtctcggacgagatgaagcagcggctccaggactccgacgtcacgaccatcgtcgccacggtcaaggacatgtcgaccgagatctacgaccagatcaagccgcagctcgaggccgaggcgctgcagggcatcgacacgggtctggacaagatgaacgagggactgggcaagctcgacgactccatcgcggagatgaagggaagcctgtccgagatgcgcgacaagaaatccgagatgaccgcgcaggccgaggatatggacagccaggcggcaaagatgcgcggcagcatcgagacgatgaacggcaagatctcgaccatgcaagaccaggcgcagacgatgaaagacgccaaggctgaggtcgatgccaaggtgaccgcgatgcagagcgcgctcgaccacctgcccgagggcacgcccgccgagcagaaggaggggctcgagaaggcgctcgcggggctgcagcaagcttccgcgcagatgcaggagggcatcgacggcatcgacaccgcagtctccgagatgaagggcgccgtgtcggggatggagcagggcgtatccggcatcgaggccggcgccgcgggcattcgcaagggcattgcgggc

SEQ ID NO: 1777 - DNA, 873 bp, Unknown
  Description of Unknown: Eggerthellaceae sequence
atgctccagaagacgcgcacagacgagcgcctcgagaaaatcctcgtcgtcgcacaggcgggcaccgacctggcgcccgatgctctcaaggaactaaaggggctcatctggatcggcaacaccgagccgccgcgcggcatcgacagcctgtggatttcttcccaagtcgacccgatcaacgtgttctatcgcgtgctcgacctgttcgagcactataacgagtgggaaaacgacctgcgcgacatgctcttgaagcgccgccccagcaaggaggtcgtcgcaaagatcggcgaggtcacgcaacggccgttttggtatgcagacgcaacgctgcacgtgctttacatgagcgacgcgccaaagctctccaaggtgagcgagaagtggcgctaccaggagaagacggggcgttaccccaacgacgtcatcagcacgctcgtggcaagcggcgagctcgacctcatcaacaaccacccgcacgcgtggattttcgaggttgccggcagccaaacctacacgctgccgttcgtgtccaagacgatcagcctgaacggaggcgtctatgggcacatcttcatcatccaagacgagccgggacatgccgcatgcgacctcgcctttgccgagacggtgggcaatctgatcgcgacctacgtccagcacagccgtaacagcggatacagcggcaagcgctactccgagcagctgctgcgctcgtgccttgccggagacgaggtgagccaggaggaacgcgccgagctgctcgccatgctggggtggaacgacagcagcaactttgccgtggcggtgttcgaccgctgcgaggcatccaacggcaggcaggaggcgccgcaggtccaagtcgaccagctc

SEQ ID NO: 1778 - DNA, 1164 bp, Unknown
  Description of Unknown: Eggerthellaceae sequence
atgccaggaacgattgttgtcggtacgcaatggggcgatgaaggcaagggcaaagtcaccgacctgctcgccggaaaatacgattatgtggttcgctaccagggaggcaacaacgccgggcacaccgtcatccacaacggcgtcaagctcgccttgcacctgatcccctctggcatcatgtacgatacggtcacgccggtcatcggcaacggctgcgtcatcgacccgcaggtcctgtgcgccgagatggccgacctcgaggagaagggcatctccaccgacaaactgctcatcagcggcaacgcgcacgtcatcatgccgtaccaccgcgacctcgacggcgcttccgaagcacgtctgggctccaacaagatcggcacgacgcgccgtggtatcggcccatgctaccaggacaagttcgcgcgctatggcatccgcgtccaggacctactcgacgagaagatcctgcgccagaagctcgaggcggcgctcgcggtgaaaaatgacatcctgtcgtccatctacgacatgcccacctacacggtcgaccagatcgcgacggaatacctcgagtacgctgagaagatccgcgcacacgtcgtcgactgcacgaggctgctcaacgacgcgctgcgcgccggcaagaagatcctgttcgagggcgcccaggcgacgcagctcgacatcgaccacggcacctacccgttcgtcacgtcgtccaattgcacggcgggcggcgccatgaccggcacgggcgtcggccccacgaacgtccagaaggtcctgggcatcgccaaggcgtacctcacgcgcgtcggcagcggtccgttcccgacggagctgttcgacgactacggcgcgacgctgggcgaggcggggcacgagtacggcgtcacgacggggcgcaagcgccgctgcggctggttcgacgcggtcgtcgcgcgctacgccgtcgacgtcaacggcctgacggacatcgcgctcaccaagctcgacgtgctcggtgccgtcgaccgtatcaagatctgcactgcttacgaggccgatggccagacctacgattacgtgcccagccagcagacggcgttccaccacgccaagcccatctacgaggagatgccgagctggaagtgcgatatctccggctgccgcacctacgacgag

SEQ ID NO: 1779 - DNA, 1293 bp, Unknown
  Description of Unknown: Eggerthellaceae sequence
atgagcgtcatcatcgatgtgtacggtcgcgaagttctcgattctcgcggtaatcccacggtcgaggtcgaggtcgcgctggacgatggctccttcggccgcgcaacggttccttctggcgcctcgaccggacagttcgaggccgtcgagttgagggatcccgagtcggctcgctaccttggcaaaggcgtgctcaccgctgtcgaccacgtaaacgaagagattgccgatgcgctcatcggcatggaggccaccgaccaacgcgccatcgaccagacgctcatcgagctcgacggcacgcccaacaagggcaagctcggcgccaacgccatcctcggtgcttctctggccgttgccaaggcggcagcggagtctaccgagctcacgctctacagctacatcggcggtgccaacgcgcatctgcttcccacccccatgatgaacatcctcaacggcggcgtgcacgccgacaacagcgttgacttccaggagttcatgatcatgcccgtcggggcgtccacgtttgcggaaggcctgcgctggtgcgccgagatctaccacacgctcaagaacgtcctcaaggagaagggcctttccacgggtgtcggcgacgagggtggctttgcccccgacctcaagaccaacgccgagcccttcgagttgatcaccgaggcctgcctcaaggccggctacacccccggcgagcagatccgcttcgccatggacccggcctcgaccgagttctacaatcccgagaccggcatgtatgagctcaagggcgagggcaagtcgttcacgagcgagcagatggtcgactactgggaggcgctcgtcgccaagtacccgatcgtctcgatcgaagacggcatggcagaagaggactgggacggctggaagatgctcaccgagcgcatcggcgaccgcgtccagctcgtgggggacgacctgttcgtcaccaacgccgagcgcctgcagaagggcatcgacctcggcgtcgccaacgctatcctcatcaagctcaaccagatcggcagcctgaccgagacgctcgacaccatcgagctcgccaagaagaacaactacacctgcatagtcagccaccgttccggcgagtcggaagacacgaccatcgccgacctgtccgtggccgtcaactccggccagatcaagacgggcgccccgtgccgcaccgaccgcatcgcgaagtacaaccagctcatccgcatcgaggaagagctcggcgcttccgccgactacgcgggcaacgacgcgttctacagcatcagcaaataa

SEQ ID NO: 1780 - DNA, 1557 bp, Unknown
  Description of Unknown: Eggerthellaceae sequence
atgttcgatggccgagaaggatgctgcgtgactgacgagagaagaacagacgacgagccgaagcgcgtttcccgcgaggagcgccatcgtgccagctcacatgggcgggagtctttcgatcacgtgcacgtctacgacccgtatgccgacaggtttcacgaggaggacctcggcgacgagtactacgagcagctcacgcacacgaagcaaaatcccgtctcgcgcatcgtcaaccagtgggtcgaccgtctcgtgggcggggtcgaggaccgcagtttcgccgaccaggaggcgcagtacgccgcgcaccgtaccaagcgcgactacgtgtggaacacgatcggcgtcggtctgtggggcatggtgttcccgatcctcacgatcatcgtcacgcagctcgtcggcgcggagcaggcgggcctgttctccttggcgttcgtcacgggcacgctgctcatgttcatcgccaactacggcgtgcgcacgtttcaggtttccgacatcgacgaggactactcgtttgccgactaccagataaaccgcattctgacctgcatcatcatgctcgtggtcgggttcgcgtactgcatgatccgcgggtatgcgggggacatgttcgtcatcagcatgggaatctacgtctaccgcatgatcgacggtctggccgacgtgtacgaggggcgtttgcagcaggctgacaagatgtacctcgcgggcatctctcaggcgtttcgctcggcgctggtgttcgttgtgttcacggtggtgctcgtcctcacgcgcagcctcgtcgcctcgtgcatcctcatggcggttgcctcggtgttctcgttcatcgtcttgacgctgccccttgcctacatggaaacgccgcgctcgcgccgggggagcctgaaaaacgtcaacaagctgctcaagctgtgctttccgctgttcttcgcgctgtttttctacaacctgatcgacaacatgcccaagttcctcatggaaggcgcgctcgcgtacgagaaccagctgtacttcaacgccatctactttccggcgcacagtatcctgctgatcatcggcatggtgtacaagccgcttctgctccgcctgtccgaggcatgggacgaccccgccaagcacaagcagttcctcgcgattatcggcgccgtgatgggtgccgatgtggcagcgacgctcgtcatgatgctgctgatggggtggatcggcatcccgattatgtcagtgctttacggaattgacttcgagcagttcaggtacctggtctacatcatgatcatggccggagggctcaccgcggccatcgagtttttatatcaggtcatcacggtgcagcgccgccagagcactatcgtcaagctctatctggcgacattcgtgttctcgattgccgcgacgctcatcttggtgcacacgatcgggctcatgggggcggtgctcgcgtatctgctcgagatgctgctcctcgtcgtgctcctcatcctgcagttcgcaaacatcaagcgttctccggggcacgccatcgagggcgtcggccaaagctggtactag

SEQ ID NO: 1781 - DNA, 1776 bp, Unknown
  Description of Unknown: Eggerthellaceae sequence
atgcccgatacaacaaagtctcccgcagaggaaaaggtcccgcagcgcacgagcaacagctcgcggcgcaggggatcccgcaggcgaggacgcaataacggatcgcacaagaagaaatcgccttctttgcgcatcatcccgctgggtggtctggacgccatcggcaagaacatgaccgcattcgagtgcggggatgacatcatcctcgtggatgccggcctcatgttccccgacgacgagcacgtaggcgtcgacctcatcttgccggactatacctatattctcgagaacgccgagaagcttcgcggcatcgtcatcacgcacggccacgaggaccacacgggcgcgttgccgtaccttctgaaggacctcgatcgccgcgtgccgatccttggcaccaagctcacgctcggcatgatcgagggcaagctcgaggagcaccgtctcaccaagcagcccgagctgcgcgaggtgcaccgtggcggcagcgccaagctcggatgcttcgaactcgagttctataccgtcaatcactcgattcccggcgcgatgggcatcttcatgcacacgccggcgggcaatgtgctgcacacgggcgacttcaagctcgaccagactcccatcgacggcgagctgaccgactttgccgcgctcgcgcgcttctccgcccagggcgtcgacttgttcatgtccgactcgaccaacgcgacgaagcatgagttcacgaagtccgaggccgaggtcggcgtcacgctgcgccgcgtcatcggcgcggccaaacagcgcgtcatcgtggcctcgttctcctcgcacatccaccgcgtgcagcaggtctgcgatgcagcccagctcgcgggccgcaaggtggctgtcaccgggcgctccatgctcacgaacacgcgcatcgcacgcgagctcggctacctcaacgtgccggacgacctgatcatcgatgcctacgacgccgccgactacgctcccgagaagatcgtcgtgctgtgcacgggcagccagggcgagccgctgtccgcactcgcgcgcatgtcggtgggcgagcacaagtccatcagcatcgagcgcggcgacacggtcatcatctccgcaactcccgtccccggcaacgagaagtccgtcacgcgcgttgtcaaccagctcgccaagatcggcgccgatgtctgggacaagaaccgcgcgctcgttcacgtctccggccatgcgggcgccgaggagcttaagatcgtcctgtcgcttgtcaagcccaagtacttcttgcccgtgcacggcgaggcgacgcatctgcgcgcgcatgcccgcctggcagaggcagtcggagtcgatcccgaccacatcttcatcctggacaacggcgactcgctcaggatgcaaaacggggtggtcaagcgcgacgctccggtcgaaagcggcatcgtgtacgtggatggctcctccgtcggcgatatcgaccaagacgtcttgcgcgatcgccagtcgatgtcttcggagggcgtcgccgtcgcggtggtcctcgtcgaccgcaagaagaacaaggtcatgggcgagccgaccatcatgatgcgcggcatccccggtttcgacaacgacgacttcatcgaggacgcctgcgcgacggtgaaaaaggccatgcaaggcgccctcgacgcgcacaagggggagacgaatcgggccaagaaggtcacgcgcgacgcgctgtccaagttcctgtggaacagggcgcaccgccgtcccgtcatcatgcccgttgtcatagaaatctaa

SEQ ID NO: 1782 - DNA, 477 bp, Unknown
  Description of Unknown: Eggerthellaceae sequence
atggcaaagcaattagtcgtggaccccaagaagtgcaagaactgccgcacctgcgagctcgtgtgctcgtttcggcacttcgaggagttcaacccgaggctgtccaacgtgacggtcttccagtacgagcaggcatccatcaccgtccccatcatgtgcatgcaatgcgatgaggctgcatgcgcggcgacctgccccaccggagcgctcacgcgcgacgcaaatggcgtcatcacgcacgatgcgaacaagtgcatcgtatgcaagatgtgcgtcagcgcgtgccccctgggcaacgtctcgtactcccccgcgaagcgcaccatccacaaatgcgacatgtgcgatggcgagacgtggtgcgcgacctactgcccgtctggtgcgatcagcgtcgtcgacccgaacgaggcccccgacaaaaagcagctggcggcagacaagatgaaggcaacgctcgaggaggtgcaggcataa

SEQ ID NO: 1783 - DNA, 1317 bp, Unknown
  Description of Unknown: Eggerthellaceae sequence
ggcctctacgtcggcatggtctcccccgtgcgcaccgtcgtgcagctcggatttggcgtcgacgattccacgggcatctggatgatcaacatctacacgctgttctacgcggcgctcatcccgatcatcggcaagctcgccgaccgccacggccgcaagctcgtctttaccgtctgcgtcgccatctttgccttgggctcccttatctgcggcctttccgagcactttggcggatttgggatcctgctcgtcgggcgcgtcgtccaggctgccggcgcgggcggcatgatccccgtcgcaaacgccgagatgggcacgtcgttcccgcccgagaagcgcggcatggcactgggaatggccgccggcatcgtcggcgtggccaacgtcctgggcgcggcatgcggcagcgccatcatcgggctcgtgggcaccgacaactgggctgtcatgttctacctggccatccccttctgcctgctcgtcatcatcggcgcgatcgtcttccttcccacaagcacgctcgagaccgaaagccgcatggacctgttcgggtcgatcttctttgccctgttcgtgctcatgctgctgctcggcttgaaggccatagacttcttcgactttggcgcgaccatcgtccagcccggcgcgtgggtacccctcgtctgcgccgccatctccgcattcatcttccgcatcgtcgagaaaaacgcgcaggacccggtgtttcacctggagtacttccacaaccgcgccatcgtcatcaccatggccgtgtcgtttttcatcggctgctgcatcatctcgatggtgctcgtgcccgaattcgccgagttcgcgatgggcgaccccgtcggctcgggcggctactacgtgctcgccattggcctgctctccatcgtggggccgccgctcgcgggcaagttcatcgaccgctttggcgccaagcccgtactgatgagcggtctggtcgtcatgatcgcgggctttctctttctcgcgttcgtggcggcgaaaagcccgagcgttccgctgctcgtcctgggactcgccatcgtcggcctgggcatgggctttgcgatgggcgccccgaccaactacatgattctggagaacacggaccccaaggacagcaactcggccatcgccacaatcgcgctcgtgagacagatcggcacctctctggcaccggccgtgctcgtcggcttcatctcgcagggctccggcatgctgggctaccagcagatgctcgtctgcgtggccgtgttcaacgcaatctcgttcgtgctcatgctgttctaccgcgagcgcgcgctgtaa

SEQ ID NO: 1784 - DNA, 1314 bp, Unknown
  Description of Unknown: Eggerthellaceae sequence
atgagcgagcgctcgccgcgcaagcggctctccttcgcgctgtacgtggcgggggcatttgtcctgaccgccgccatgacggtgctcatcacggcgggcgcgattgtgttcgcgtggaacctgggccgcggcgccatcgtcaacgacgaggagctcttcgtcatcctcatcatcgcgggcatcatcgccctcgtgctctcggtgtttctgggcctgtactttgcggcgagctttggccagcccatcgacaagatctccaagaccgcaaaaaagatcaaggaaggcgacctttcggcgcgcacgaacctgcgcggagacagcgacctcgagcagctgggcgagaacttcgacgagatggcggacgccatcgagcgcgaccgcgacctcgaacgccagctcatcggcgacgtcgcgcacgagctgcgcacgccgctcatggccatccaggcaacggtcgaggctatccaagacggcgtgttcgaggcggaccaggagcatatgggcaccatctcctcggagacccgtcgattggggcgcctggtcgaagccctgctgcgtctgaaccgcctcgagaacggcacgaccgagctcaaggtagagaccatcgacctaagcgagctcgtctcagggctcgccatgtcgcaagaggccctcatcgagtcttcggggctttcgcttctcaccgacatcgaagacgacatctacatcgagggcgaccgcgacctgatccaccaggccgtcgtcaacctcatgtccaacgccgtgcgctatacgccggaaggcggcagcatctcggtcgagctgcgccgcgacaacgggtacgcgtcggtctcggttgccgatacgggcgtgggcatcgcggagaaggacctgaagaaggtcttctcccgcttctggcgcgccgacaccgcccgcagcaacagcggcggcctcggcatcggacttgccctcgtgcgcgaggtggtcgaccagcaccgtggcaccgtctcggtggacagcacgctgggcgagggttccacgttcacgctcaacctgccgctctctccgctcgacccctccatgatcgacccggcggacaagcgcgcgcaggagcgccgcatgaagcgcgccgcaaaaaaggagctcgagaagcagcgtaaagagcaggacaagctgcgccgcctgcaggagcgtcaggagcgcgagcgccgcaaggcggccgagcacggcaaggggctgacaggcgagtggaaagtgagcccgcagcagctgacgctgttcggaatccgcgtgcccctgccgtccaagaaagataacgacgaatctaagcgctag

SEQ ID NO: 1785 - DNA, 1110 bp, Unknown
  Description of Unknown: Eggerthellaceae sequence
atggcatccgaccaaatcgtcatcaagggtgcgcggcagcacaacctgaaaaacatcgatctttcgattccccgcgacaagctcatcgtcttcacggggctgtccggttccggcaagtcgtctctggccttcgacaccatctacgcggaggggcagcgccgctacgtcgagtcgctctcgtcgtacgcacgccagttcctcgggcagatggaaaagcccgacgtcgactccatcgacggcctgtcccccgccgtctccatcgaccagaagacgacgagcaagaacccgcgctcgaccgttgcgaccgtgacggagatctacgactacctgcgcctgctctacgcgcgcgtcggcgtaccgcactgccccgtgtgcggccgcgtcatcgagaagcaaacggccgaccaggtggcggacaaggtcatggcgcacggctccgagggcgacaagctcatgatcatggccccactcgtctcgggcaagaaaggcgagttcgtccagaccttcaaagaccttgccaaagagggcttctcgcgcgtgcgcgtcgacggcgaggtgcaccgcctggacgaagagctcaagctcgacaagaagtacaagcacaacatcgaggtcatcgtcgaccgcatcgtgctcaaggagaaatcgctcgcgcgcctcgtcgaggccctggagacggcaacggcgctcgccaagggcaacgtgatcgtcaagaacctctccgaagacgagaacctcgaggtggagagcacgcaaggcgcaaaggcagcggccggaatcgccaacgagtactccttcagcctcgcgctcgcctgccccgaccacgactactcgctcgacgagctcgacccgcgcgacttctccttcaacgccccctacggcgcctgccccgactgcctgggcctgggcttcaggcagggcgtcgaccccgacctcgtcgtccccgacaagtcgctgagcgtcgccgagggggccatcgcgctgtggagcccctcgtccaactactacccgcaaatgtacgccgccgtgtgcaaggaggtcggcgcatcggtcgacacgccgtgggaggagctttcggccaaggcaagaaaggcgctgctctacggcctg

SEQ ID NO: 1786 - DNA, 966 bp, Unknown
  Description of Unknown: Eggerthellaceae sequence
ggcggccgtcacagcgcatcttccaggtacgcgcgcgattcgtacacgagctcccgctccgggcacgcgcgcgagcgcgacgatcgcagcggctccaatgcgcaccgccatgacgagggccgacgccttgcgggcgggcgcgggctcaagccgtatgtggcggcgctcgtcgcggcggccgtcatcatcgccatcgtcgtcattgcgaacccgttcaaggcggcatacaccatcgccgacaagcagggcaccagcatgaacgccacaaacagcgcggcttacgattcttcggcagacgatgcgctgccgacgccgatcatcgccgagagcaacggcgtccagctgcattcggcggttgccgccaacgacctgaccgagatcctcatccacaacgcgtcgtatgcgtatgcggcgccgctcacgaccaaactcaccgaggcgacgaacaccgaggtcatggccaatcacggcacggggcgcaacgcggacgagcagccgacgggcgacaagtggatgaccggcgagtttatccgctgcttccgctcgaccaacgcggggcccaagatgagtgccatcgactgcggcggcaaagaggggacgacggtctactcgcctgtaagtggcaaggtcgtgctggtcaagcagtacaagctctacgagaagtatgacgattaccagattcacatccagcccgacgggcaccccgagctcgacgtcgtcctgattcacctgaccgacgtatccgtgaaggcgggcgaccaggtgacggcgggggagagcaagatggcaaagatccgcgacgtctacgccctgatcggcgaggagatgcagctcaagcagtacacggcggagggcgacaacggcaaccacacccatattcaggtgaaccttgcgaacgacccgagttaccacgggctcgatgacttgaagcagggaacggccgcttcgggagcttcggcaagctag

SEQ ID NO: 1787 - DNA, 957 bp, Unknown
  Description of Unknown: Eggerthellaceae sequence
gtggcacaacaggagcaggccccctcgggcacggactcgaaacagcccaaagacctcgacgtaggcgaatacgccgagagcttcggagcgctcaagacgagcatgtcgcagggccgcgacctgaggaagcgcaaggcagacctcaaggcgtatcgagagcagacggcaaaggacaaggcaacgtacgaggacgaggcgaacatcctcgccaactacgaccaggtcgtcggcgagcagcgtgatctcatcgcaagcacgcagcgcgagctcgacgtccaggccgagcacatggaccggctgaatgccgatctggcgcaggccaaaggcgatctggcgaccacccgcagccatgacgaatcggcgctcgcagacctcaagcgcgagctcgacgccaaggtgaaggcgtcagaatcggcatacgaccaggcaaaacgcgcaagcgagcaggcaaagacgcgtcacgagcaggcgcagggcacttcttccgaaagcgagatgctggaagtgctcgagcgcgccgatcagcagaaggcggcggccaaagacgccttcaaatccgagcgtgacaccgccaagcgtgcctacaagaagcaaaaagacgcattcgacaaggcggaaaagcccctcgagacgaaggtcggcaagctcgaggacgaggttaagcagctgagcgccgccatcacgaagaaccggggtaccatcgccgcggcgcagcagcgagtcgcgtactgcgagcaggtgcatgacgaccccgcacgggtcgagacgctcaaggccgaaatcgagcgtcgcgaggctcaggagcagcgcatgcaggcagacatcgatgagctcgccgatcagcgtgccgaggtcaagaagtcgaccggtaaggcgaaaggcgcactcatcgcccttgccgtactcgtggtcgtcatcatcgtcgcgatcgtcgtcgtgacgacgcgtggcttctga

SEQ ID NO: 1788 - DNA, 921 bp, Unknown
  Description of Unknown: Eggerthellaceae sequence
atgcagccagacaccaacaacgcacacggggccttctctgctacaggggaggccttcgtggatttctgcgagaccatcgccgcgctgcgcgctcccgacggctgcccgtgggacagggagcagacgcatacgagcatcgcgagcaacatgatcgaggaggcggcagaggcggtcgatgccatcgagcgtgacgatatgcgccatatgcgcgaagagctcggcgacgtgctgctgcaggtggtcctccaggcgcagatagccgccgacaacggcgagttcaccatcgacgacgtcatcgccgacatccagtccaagatggtccgccgccacccgcacgtctttggcgtggagacctcgcttgcggcagcgggcttctcgccgcgcgaggtcgaggaggcaacgacccccgggcgcgtgctcgacatgtgggagcacatcaaggcgcacgagcgcaagctcgagcagggcgccgcgcgcaaggaggcgctcgcccaggggctcgaccccgatgcgccgcgcccgctgctcgacgatgtgccccgcagcctgcccgctttgcagcaggcgcagaagatctccaagaaggcggtgaacgcggggttcgagtgggacagcgtcgaggacgtctgggcaaaggtcgacgaggaggtcggcgagtttctcgaggccgagcccggcagcgcgcacgcggccgaggagttcggcgacgtgctgttcacgctcgtcaatgtggcgcgcaaggagcacatcgacgccgaggcggctcttcgcacggtctgcacaaaattccgcaggcgctgggctattatggagcagcatgcttacgaagacgataagcagcggattgacacgctcccgcgcactcgactcgaaagtctgtgggaccaagctaaagaagagctgagaaaggatcaacaatga

SEQ ID NO: 1789 - DNA, 1131 bp, Unknown
  Description of Unknown: Eggerthellaceae sequence
atgccagggctctcgttcagcaaccagaaccagagcagacgaccgggtctctggtggattccgatcgtcttgatcgttctgtcaatcgtcctcatcacgctgtgcgtgcgcgcagacggtggtggggcgtttgccgctgcccgcaacgcggtgcagacggtctccaagcccatcgagcatctgtgctcggggctctcgacgccgttcaagggcgtcgcgagcattggtaccgacgacgagaaggagcagttgcaaaaagagaacgagcaactgcgcacgctcgtgagcgagctcgaggagtaccgccagcaaaaccagcgcctgctcactctcacgcagctcgccgacacctacgcgctcaccaccgtcagtgccacagtcgtggataccacctccgggtgggatcgcaccgcgaccatcaacaagggcagcaacgacggcatcgccgtgggcatgggcgtcatgagctcgtgcggcctttacggccaggtcgagtccgtgaccagcactaccgcaaccgtgcgcctcatcaacgacgcgcatagctcggtttctgccatggtgcagggctcgcgtgcgcgcggcatcgtcaagggcgcatacgacggcaccatgacgatggagtacgtgcccgtcggctcgacggttgccgagggcgacatggtcatctcctcgggcgagggcggcacctatccccatggcatccttgtcgggacggtccgcaacgtcgaggtcgactcgtccaagctctactaccgcatctcggtcgagcccatcttcaacttgcaatcgtgcgaggaagtgctcgtgctgaccggcaacgaggacagcaccgcgacggtcatcgaccagacgctgctcgaccagatcatcgcgaactcccgcacgtcctcgtccgacacggcgagcgcaggcacgggctcaagctcgagctcgaacgcccagagcaccggcaccccgtcgacgtcagacacgactgcctctgcgcaggcctcttcccaggacggctcgagcagcgcggcgacgggcaccagcactgccgcggacacgagctcttcgggcaagagcggctctgccggcagctcgagctcgacggccggagccgcggcatcgggagggtccaatgagtaa

SEQ ID NO: 1790 - DNA, 1428 bp, Unknown
  Description of Unknown: Eggerthellaceae sequence
tcgggcgaggcggacagcctgcgccaggagatcgggcgtctcgagcaggccatcacgtcggcgcagcaagagcgcgagcagattgcgcagcgccgcaagaagatcgtcgacgactccgcgaagtcgcgcgagctcgtcgccgagctcgaggagcgcaaagagacgctcgagaaggaaaaagacgagctcgaagagcagctcgcggtcgcgcgcgaggaacgcggcaacctgttcagacgcgaagacgtgttcacgcgcaacatctcgacgctgcaggtcgatgccgcgacggtgcgcgagcgcgaacggcacctcacgcagcaggtctcctcgctcgaaaaagagctcaaggaccttaaggactcgcttgccgtctcgcatgagacggagaacagcctcgagatcttgcggctgcgcgtcgagccgctctacgaggtgttcacggagctgcggggctacgtgaccgagaaggccgagctgctgcgcgaccaggcgcagctcgagcaggcgggccaaggcgacctcaaggcggcgatcgaggctgcgcgcaagaacgtggcacaggcacaagacgagcttgccaaggcgcagggaaagctcaccgagctgcgcatcaagaagagcaagctcgaggtcaaggtcgagcaggccgtcaagaccatcaccgaggaaaacggcgtgctgctcgacatcgcgctgcagattcccgcaccgcaagaccgctcgagcagcgaggcacgtgccgaggccctgcgaaagaagctgaagaacctcggctcggtcaaccccatcgccatcgaggagtaccgcaagctcaaggaacggcgcgatttcatcgccgtgcagctcgaggacctcgaggcggcacgcaaggcgctcaagcgcatcgtggcagcgatcgaccgcaagatgcgcaaccgcttcctcgacacgttcgagcaggtcgacaagaacttcgaggagatattcgcccagttgttcccgggagggaaggggcatctcgagctgaccgaccccgattctccggaggagaccggcgtggaagtgcacgcacagccgcgcggcaagacggtgcgcaagcagacgctgctctccggcggggagcagtcgctcgtcgccatggcgctgatgtttgccgtatacaaggtgcgctcgacgccgttctacatcctcgacgaggtcgaggcggcacttgacgacacgaatctgcgccgcctgctgtcgtacctcgacagcgtccgcgaccatacgcagttcatcatgatcagtcaccagcggcgcaccatggagatggcagacctgctctacggcgtttccatgcgcagcgacggtgtctccaagctcgtctcgcagaagctcgaccaggctatccgcctcgcgcatacgagtgaggccaaagacgtcgacgagttcagcggggcacagtaa

SEQ ID NO: 1791 - DNA, 1401 bp, Unknown
  Description of Unknown: Eggerthellaceae sequence
ttggctaagaagacgacggaaaaagccggtatcacgaaggccgaagctgccaaagcccaggcgaaggcgcaggccgacgaaggggtcctgaccgagggcctcatcgagaaggccgacgagctcatcaaggaggttggcaagaaggtcgagcgctccatcgtcgagagcaccttcgatgacgacgacctcaacgacaagcagctcggggcagtctacgactacctgagcgccaacggcgtcaagctgacgggcaaaagctcgatcgacgtcaccgagtcgagcgacgacgagataaaccccgacatgtccgacgacgagatcatggacggcattcccgaggacgagctgcgcgcgagcaaggctgccgacgagctgggccaggtcaacgagatagaccccaagaagaaggcggccgagtccaagaagcgccgtgccgaggcccgcaaggcacgcatcgagcagaactccgttgccatgctcacgggcgatccggtgcgcatgtacctcaaggaaatcggcaaagtcgaccttctgacggcgtccgaagaggtcgacttggccatgaagatcgaggccggcctgaaggcaaccgaagaaatcgacaaggcggaagaagaggggcgcgagctcacgcgccgcgagcgtcgccgcctcacgcgtgtcgagcaggttggactcgacgcaaaagatcagctcatcgaggcgaacctgcgtcttgtcgtctctattgccaagcgctatgtgggtcgcggcatgctcttcctcgacctgattcaggaaggcaacctcggcctgatccgtgcggtcgagaaattcgactacacgaagggcttcaagttctccacctacgccacgtggtggattcgccaggccatcacgcgcgcaatcgccgaccaggcgcgcacgatccgcatcccggtccatatggtcgagaccatcaacaagctcgtccgcatccagcgccagctgcttcaggacctcggccgcgagccaacgcccgaagagatcggcgagaagatggacatgagcgccgagcgcgtccgcgagattcagaagatcagccaggagccggtaagcctcgagacccccatcggtgaagaggaagactcccagctgggcgacttcatcgaggaccacgaggcgatccgccccgacgacgcggcgggcttcacgatgctgcaagagcagctgggcaaggttctcgacggcctggccgagcgcgagcgcaaggtcatcgagctgaggtttggcctgaaagacggtcatccgcgcacgctcgaggaggtaggccgcgagtttggcgtcacgcgtgagcgcattcgccagatcgagagcaagacgctggccaagctgcgccacccgagccgctccagcaagctcaaggactatctcgaggactga

SEQ ID NO: 1792 - DNA, 2004 bp, Unknown
  Description of Unknown: Eggerthellaceae sequence
cagggcagcaccgacttggcccagctcaggaaagagtcgggcgaattcggcaactcgctttccaccgcgatcgttgacacgggcgtggcgctgggcaagacctctgcgcaggtggcgagttctgcctcgaacctggccaaggcagcagacgaggctcagggctcggtctctgccgcaaccgaccgcatcgacgcgctgatcgacgccaacaacgcgctcatcacgcagctcgagggctcgaagaccgggctgccagacgatgcgcaggcaaccatcgactcgaccatcgagctgctcaagaagcaaaacgagaatctgcgcaacacggcgagctcgcttacgcaggtgagctcggacatcgcgaaggcgacgggcgaggcatcgcaggcgatcgacgacctcaacgacgacgtgcagcagggcacgaagaacgtgcaggatgccggcacggcctacaccacccagatccagcccgctatctcgagcacggcagacagcctcgcggggtcgctttcctcgctgtcttctgcgacgcagaccctcactcccaagatcaagcagctgcaagatctgctgtccaacgtcgacagcacgctcaagcaggcgcaaggctcgctcacggacgccagcacgtccatcaagggcacgcgcgaccacgtggattcgaccatcacggacctccacggcatcatccagtcagcggagcttgaggggctttcttcggtgctgggcctcgagcctacgcgcgtcggcgacttcatgaagtcgccggtcacgctcacgacggagaagctctacccgcttgagcactacggcgcggccgtcgccccgttctactgcaacctcgccatctggatcggctgcttcatgctgatcgccatcttcaagctcgaggtggacaaagagggcttcgagaacatgacggcgacgcaggaatacttcgggcgctggctgctgttcgcgatcatgtccgccatccaggcgctcatcatctgcgtcgggtgcgtcgcgctcggcatgggcgtcgagaaccccgggctgttcgtgctcgccggcctgttcacgagcttcgcgttcgtcaacatcgtgttctgcctggccatgctgttcaggcacatcggcaaggctctcgccgtcatcttgctgatcatgcagatccccggctcgtcgggcatgtatcccatcgaggtcatgccgccgtttttccaaggcgtgcacccgcttctgccgttcacgtacggcatcaacgcgatgcgcgaggcggtgggcggcatgtacgacggcgtctatgtggaaaatctcggcatcctcgtcgtgtttgccctcgtcgcgcttgcactcggcctgctgctgaggccctatctgctcaacctcaacgcgctgttcgacaaccgcctcgagcgcacgacgttcatgatcacggaaaaccagggaaggacgcgcccgcgttaccgcgtgcgcaatgtcgtcaaggcgctgctcgccaacgagcactaccacgacctgctcatcaagcgcatggtcggcttcaaccgcatgtacccgcgccttgtcggcgccgggcagttcctcgtgttcttgctgccgttgctcgtcatcgtcgtctcgtcgctgttccacacgcatcaaaacgcgaagatcatcctgctcgtggcgttcgtgctcacggtcgtcgtcatcgacggtctcatgatcttcaccgagttcatgcgcgacaacttcgaaaaccagctgcgcatgagcgcgctcaaaggcgacgagctcgtcaacgacatgatggaccacgtgcccatcgaccaccgcgatttctcggccaaccatgccgagaagacgcgcgagaacatgcgttcctggcgttcgtggcgcatcagcctcgacgaccttgcggccaaggccatgtcagaagacgagctcgacgatgcggcgcggcaaggccacgcggccgatgacgccccgggcatgccatctgacgaaggtgccgatgagaggggagggcgctcgtga

SEQ ID NO: 1793 - DNA, 1080 bp, Unknown
  Description of Unknown: Eggerthellaceae sequence
atgtacgaaaagctgaagaaaatcatcgaagcatacgagggactcgagcagaagctcgcggatccgtcggtgctcgcggaccagaaggagtacacccgccttgcaaaggagcactctcgtcaaagcgagctcgtcgaggcggcgcgcaagtacatctcgctgtgcgaccagctcgaatcggcaaaagaggaaatcagagccgagagcgaccccgatctgaaggaacttgcgcaggaagaggtcgccgagctcgagcagaagattcctccgctggaagatgacatcaagttcatgctgcttccggcagaccccaacgacgagaaggacatcatcgtcgagatccgcagcgctgcgggtggcgacgaggccgccatctttgccggcgacctgttcaagatgtactcgcgttatgcggagtcgcggaactggaaggtcgaggtcatcgatgcatcgccttctgaccagggcggttactcgaagatcgagttcaaggtgctgggggacaaggtctacagctccatgaagtacgagtcgggcgtgcaccgcgtccagcgcgtccccaagaccgagagccaagggcgcatccagacctcgacggcgacggtcgcggttctgcccgaagcggatgatgtggagattgacatcaagcaggaagacctgcgtatcgatgtctaccgcgccggtggcccaggcggccagtgcgtcaacacaacggattccgcagtgcgcatcacgcatctccccacggggctcgtcgtccagtcgcaagaccagaaatcccagatccagaaccgcgaggcggccatgcaggtgctgcgtgcccgtctgtacgacaagatgctccaagagcagcaagaggcagtcggagcagagcgccgcagccagattggcggcggaaaccgttctgagaagattcgcacctacaatgctccacaagaccgcgtgacggatcaccgcatcggctacaacggcacctacacgggcgttctggaaggcgacggactcgccgacctcatcgagaaccttgctgccgcagaccgtgcggagcgcctggagcgggctacttcggaagccgaataa

SEQ ID NO: 1794 - DNA, 1125 bp, Unknown
  Description of Unknown: Eggerthellaceae sequence
ggagccgagcgagagcccaggctgctcgtgagccgcaagaagcgcaaagagaagcaccacggcaagcgcaaggtgagctttttccactacagctactacgacgtcgcattcaagttcttcatcgagcaggtcctcgatgcggagtggacgcccgtgcccccgcgcaccaagcgcacgatcgaaatcggctcgcgctacagcaccgactacgtctgcacgccgttcaagcacattttgggcgactacatcgaggctctcgaggccggcgccgatgtcttgatccagacggcgggcccatgccgcctgggctactacggcgcgctgcacgagtcgattctgcgcgacctcggctacgagttcgactgcctgaacttcgcctacctcgccggcaagggcatcgacgagtacgtcaaggccgtgaagaagatcaacccgaatctctccgtgaaaaagggcgttcgcaagctgctgagccttgccaagatgatcaccaacctggacgaggcatatgactactatctggcgcatgcgggcgcagagctcgagaagggcgccttcgatcgcgcgttgagcgcgtaccacgacgagatgcgccacgctaccaacgacagcgcgatcgcccttgcgcaccaccacggtatggatgcgatgcgctccatcccctgtcggcagggagagcgcatcagaatcggtatcgtgggcgagttcttcaccgccgtcgaccaggagtccaacctcaacaccgagcaccgtctgctcgacatgggcgtcgagctgcaccgcacggtcaacctcacgaaccgctacctctcctacagcgagcccaacctgcgggtcggcgtacgggaatacctcgcctacgacgatggccccacctcgacgctcacgatatcggccgccaagaagtacgccgagctgggatacgacggcatcatccacatcaagtcggcaggctgcacccccgaaatcgactgcatgcccatactgcagcgggtcagcagcgactaccacatccccatactgtatctgagctttgactcgcagacgagcgacgccggactggacacgcgcctcgaggcgttctacgacatgctcgcgatgaagaaaggaaaggtgctcgcatga

SEQ ID NO: 1795 - DNA, 741 bp, Unknown
  Description of Unknown: Eggerthellaceae sequence
atgacctcactgaaacgcgtcttgatcgtcgcctgcgccgttgcgctcgctgtctgcggatgctttgcgcttgcaggctgcggcaagcaggccgcggcaacctgggcgcatggcgatgtgtccgaagaggacgtgacgaagaccatcgagaacatgcgggcaaactacggtctgaccgacgacgcgacttgggcgtcgttcatcgccatgaaggcgtacgactctaccgcgaactccgatgggcagacgacgacggacggcacggtcgccgacctgcgcacctacgtcatcaaccagatgctcaagaccgacgtcatcgactacgaggtcaaagagcagaacatcaccgtctccgacgacgagctcgacgcctacgtcgaccagcagcgaaaggcagtcgagagccagtacatggcgggcgtcttcgagagctacctgcaaaagcagggctacaagagtctcgacgagtacaaggagcaggcgcgcaaggcactcgcggagcaaaagcttgccgagcaaaacggcgcgagcgaagacgacgagagcgcctggaattcgtatgtggacggcctgatgcagaacgccaacatccacatcaacgacatgccgagcggcctttcctacgacgtcgacctgtcatctgcaaccgcgacgctgtccggcggcagttccgacgcgacggcttcgagcgagggagacgccacccagggcacgagcggcaccgactcatccggcaactag

SEQ ID NO: 1796 - DNA, 1623 bp, Unknown
  Description of Unknown: Eggerthellaceae sequence
atggtaagttctataatcgaagcccgcgtgcgccgcacgcaagacatcattcgtctgatcaaaggaatccgcatgtccaaagaaccgttctacgtgacgacccccatctactatgtgaacggcgtgccccacatcggcacggcgtacacgaccatcgccgccgacaccgtcgcgcgctggcagcgcatggacaaccacgacgtctggttcttgacgggcatggacgagcacggccagaaggttgcccagtctgcacaggagcacggcatgacgccccaggagtggtgcgacagccaggtcccgcagttcacggacctctggaaagagctcaacatctccaacaacgacttcatccgcacgacgcaagagcgccacacgcgcggcgtccagcagttcatgcaggacctctatgacaagggctacctctacaagagcacctaccagggctactactgcaccccgtgcgagacgcagtgggcaaaaagcgacctgaccgaagacggcaagtgccccacttgcggccgtgacgtcgacttcatcgaggaagagaactggtttttcaagctctctgagttcggagacaagctccttgcctactatgacgagcaccccaagttcattcgcccgaagattcgcgaaaacgagatccgctcgttcatcgaaagcggcatgcacgacctgtcggtgagccgcacgaccttcgactggggcgtcccgctgccgttcgactccaagcacgtcacctacgtgtgggtggatgccctcatcaactacatcacggcgctcggctacggctccgacgacctgagcaagtacgacaggttctggccggcaaacttccactttgtcggcaaggacatcattcgcttccactgcgtgatctggccggcgatgctcatggcggcgggacttcccatccccgagcacgtgttcgcgcatggctttctcatggcggcggatggctcgaagatgtccaagtccaagggcaacgccctgtacccgcgcgagctcatcgaccgctacggcgtggacgcgtatcgctactacttcatgagcgacgtcacctttggcgctgacggcaacatcgggcacgaccgcatcacgcaggtgtacaacgccgatttggcaaatagctacggcaacctcttcagccgtgtaagcaacatgaccatcaagtacttcgacggcaaggtccctgcggtgccggcggaatttgcctcggcggaaaaccctctcaaggagattgcggacaagctctacgccacttaccgcgagcgcatcaacgacatcgacttcggcggggcgaccgccgcggtcatggagctcgtgcaccgcgccaacctgtatgtggaggagtccgctccgtggaacctcgcgaaaagcgaggagacgcgcggcgagctcgcgttcgtcttgtacaacgcgctcgaggcgtgccgtatctcggcgctgttcctcgcgccgttcatgcccgccacctcggctgagctcttcgctcgtctggggctcgaagacccggcgacgatcgaaaacgccgagcaggcgagcgcctggggcggccttcccgccggaaacgcggtgaccaagggcgatgccctgttcccgcgtctgccaaaggagtag

SEQ ID NO: 1797 - DNA, 1119 bp, Unknown
  Description of Unknown: Eggerthellaceae sequence
aacagcacccgcgccgtgcgcgccgcatccggcttcgcgctggacgccgggattgtcgcctgcggcctgatcgcctcggccctcgttgcacccacccccgcgctcgcctatgtcgacccctcggtcatgacctacacgattcaggcactcgcgggcgtcgccgtggcactgtctgccgtctttggcgtagcgtatcgccgcctgcgcaagaaggccgtgcgcgtcttcggcatcgacgagaacgccggcaaggtcatcgaccccgacgtgcgtcgcgtcgacagcgacgaggacctcgcgtccgagaacgagcgtctgggcaggttctggcgcaatgcgcccaaacccggcgaggcacgcgagctcagctacctcgagaagttctggcgttcgctcatcgtgtgcctgttcacgtgcggcaccctgctgctcctcgccccgatcgagctcatggtggccaactcgggcagcctcacctacggcctcgccgtcgtctggcgccccgtcctcgtgaccttcctcgtcgtctcgctcgtgctcgccgcgctcgtctcgctcgtgcgcggccgcgcgttcgacatcgtgcgcgccatcgtcgccgccatcggcatcggcttttggctgcaggcgctgttcatgaacgcggggctgccgcaggcaaacggcgccaccatcgactggctcgagttctggccgtggtttgtcggcaacacgctcatctgggcggcgctcgtcgcgggcaccatcatctacgcgcgcttgcaccccaagcgcacgcgctcgctcgtgaccggcctgtgctcgctgttcctcgtcatcacgctcgtcggcgcgggcatcagcgcggcaaaccccgcctctgccggcaaaggcggcgaggacgggcgcgtctacgtgaccggcgacggcatcaacacgctgtcgccttccaagaacatcgtcgtgttcgtgctcgacatgtacgacacctcgcgctacctggacgtcgtcaaggagcgcccgcacatgatggacgagttcaccgggttcacgttctaccgcaatgcgaccggctccggcgttcccactaagtacggcgtgccctacctgctcaccggcagctggcccaagcccgacgac

SEQ ID NO: 1798 - DNA, 411 bp, Unknown
  Description of Unknown: Eggerthellaceae sequence
gtgattaaagacatcgtcacggataaagaacagctcaagatcaaatcggagaaggcaacgcccgaagacaaagacgtcatccaggacctcctcgacaccttcgagaagcactccgagaccgccgtgtgccttgcggccaaccagatcggcgcgcaaaagcgcatcatcgtcatcaacaacctggggaccacgcagatcatggtcaacccgatgatcaccgacaagaagaagccctacctcacccaggaggagtgctattcgctgaagggcgtgcgcaagtgcaagcgcttcaagcgcatcaccgtcgagtacctcgacgagtcgttcgagaagcacgaggagaccttcacgggctacatcgccgaggtcatccagcatggcgtcgaccactgcaacggcatcctcatctag

SEQ ID NO: 1799 - DNA, 630 bp, Unknown
  Description of Unknown: Eggerthellaceae sequence
atggcagactttctcacacaggcatggccgtttgcggcagccgttctcgtcgtcctgggcgcaatagcactcgtcgtgctcatcgtcatcctcatccgcgcagccaagaccatggaccacgtgtccaagctggccgagcaggcagaggcagagctcacccccacgctcaagcgcatcgatccgcttgtcgatcgcgccgagctcaccgtggacacgatcaacctcgagctgctgcgcgtcgactcgattctcgaagacgtcgagcaggtcaccaacgttgccggcaagaccgccgacaccgtcaacaccgtcaccgccgctcccaccgaggccgtcgtctcgttggtagaccgcgtgcgcggggcgcttggctccaagcgaaagaacaaggcgaaggccgagcgcttcgtgtatcccatcggctccggcgagaccaagaaggaggcccccgtgcccgagcagcccgccgaggagaccatcgagcaggcagctcagcacatcgccgaggtccagggcaagcactccgtcgaccacgctgccgagcagccggctgccgatgagcctgccgccgaggtcgaggccgtcgaagtcgacagcaccgtcgtcgaggccgagcagcctgcaaactaa

SEQ ID NO: 1800 - DNA, 1008 bp, Unknown
  Description of Unknown: Eggerthellaceae sequence
atgactatcagagtcggtatcaacggttttgggcgcatcggccgtctggcgttccgcattgcagaacaggaccccgatatcgaggtcgtcgccatcaacaacccgagcgatctcgagtgcgccgcctatctcgccaagtacgactcctgccagggccgcgtcttcgacgagtgccgtgcagaagggggcgcgctcatcgtcgacgggcaccgcatcaaggcattccagacccgcgacccgcaagagctcgagtggggagaggtcggcgccgacgtcgtcgtcgagtccacgggcaagctcaaagacggcaccgtcgcgaaggcgcacctcgagaagggcgccaagaaggtcgtcatcaccgcgccgggcaagaacgtcgacgcgaccatcgtcatgggcgtcaaccaggacgtctacgacaaggacacgatgaacatcgtctccaacgcatcgtgcaccaccaactgcctcgctccgtttgccaaggtcctgaacgacacgttcggcatcaaacgcggcttcatgaacaccatccactcctacacgaacgaccagaaggtcctcgacgtgcaccacaaggacttccgccgttcgcgcgccgctgccctgagccagattcccacgacgacgggcgctgccaaggccgtcgccctcgtcatccccgagctagccggcaagctcgacggcatggccacgcgcgtgcccacgccaacgggttcgatggtcgatttgacggcagagctcgagacgcccgccacggcagaggagatcaacgcggccatgaaggcagctgccgaaggtccgatgaaggggatcctcgagtattgcaccgatccgatcgtctcgaccgacgtcatcggcaaccgcgcctcctcgatctacgacagcctgctcacgaaggtcctcggcggcgacaagggcgacttcgtgaagtgcatctcctggtacgacaacgagatgggctactcgcagcgcgtcatcgacctcgccaagttcctcgtggcataa

SEQ ID NO: 1801 - DNA, 384 bp, Coprococcus sp.
aggcaaattttgcatggctggagttcaataaggatggaggaaagatatatggaagaacataagaattgctgctgtcatcatggcggagagataagcgatgtggaagccagggtgaggacaaggacagacgaggagtataagaagcttctcaacagactgaacaggatagaggggcagataagaggcgtgaagagtatgctggaaaatgatgcctattgcacagacatcgtgctccaagtgtcggcgatcaatgcggcactcaacagcttcaacagacagctccttgccgaacatatcaggacatgtgttgcagacgatataagaaatggcaaggatgatactatagaggatctggtaaatacggttaccagacttatgaaatag

SEQ ID NO: 1802 - DNA, 1464 bp, Coprococcus sp.
agagagaagaaaatgggtaagattattggcgaaggaattacatttgatgacgttttattggtacctgcttattctgaggtattaccaaatgacgttgaccttacaacaaagctgacacagaagattaagttgaacattcctcttatgagtgccggtatggacacagttacagagcacagaatggctattgccatggctcgtcagggtggtatcggagttatccacaagaacatgtccatagagaagcaggcagaggaagttgacaaggtaaagcgttcagagaacggtgtaatatcagatccattttacttatctccagagcatacactggcagatgctgacgagcttatgagcaagttcagaatctcaggtgtacctatcacagaggatggcaagcttgttggaatcataaccaaccgtgacctgaagtttgagaaggactacaccaagaagatcaaggagtcaatgacatctgagggtcttgttacagcaaaggagggaatcacacttgacgaggctagagagatccttggaaaggctcgtaaggagaagcttcctatcgttgatgacgatttccatctgaagggactcatcacgatcaaggatattgagaagcagatcaagtacccatattcagcacatgacgcacagggcagacttctctgtgcagcagcagtaggatgtacagccaacatcctcgacagagttgcagagctcgtatcagcaaaggttgatgcgatagttatagatacagcacatggacattcagccaacgttctgagaaccttcaagatggttaaggagaagtatcctgaccttcaggttattgccggtaacgttgcaacaagatcaggcgcacaggctatgatcgacatgggtgtagatgcagtcaagatcggtatcggacctggttctatctgtacaacaagagttgttgcaggtatcggtgtaccacagatcacagctatcatgcaggcatatgatgcagctatgaatgccggaatccctgttatcgcagatggcggtatcaagtattcaggagatatcacaaaggctctggcagcaggtgccaacgtatgtatgatgggaagcctgttcgcaggtacagatgaggctcctggtgatttcgagctttatcagggacgtaagtacaaggtatacagaggtatgggatctatagcagccatggagaatggttctaaggacagatacttccaggagaacgcaagaaagcttgtcccagagggcgttgagggccgtgtggcatacaagggatcacttgaggatacagtattccagctcatcggtggacttcgttcaggtatgggttactgcggagcaaagaacattgcagagcttcatgagaaggcagagttcgtcaagatttcagcagcttcactcaaggagagccatccacatgatatccatatcacaaaggaagctcctaactacagtgtagagtaa

SEQ ID NO: 1803 - DNA, 480 bp, Coprococcus sp.
atgtatagaaacaacaggatggagaaaatggcggaaatagagaaggtaatatttatgaatatgtgcatggtatatgatcacgctgggcgtgtactggcactcgataaagtagggaaaagctattctggaacgacattccctggtggacatgtggaacctggagagacattcacagaatcggtgatacgagagatatatgaggagaccgggctgaccataagcaatccaaagctcaccggaatatatcactggatgaccggagctgtgagaaatgtcggatttctgtacaagacggatgagtatcaggggaaacttatatcttcagaagagggcaaagtgtactggatatcgggagaagagttcctgctaaaaccgcttgcaccaggaatggaacaggtgtggcagatgatgcacgatgacagtgcgtcggaatgtctgcagacacttacggaaaatggcatagtttcaaagatacaataa

SEQ ID NO: 1804 - DNA, 603 bp, Coprococcus sp.
ttgataatcttggaaatactctatactataaaacacaggcagggtattgatatgataaaaaagaagcagcgacaaacagaatattttaatccaaatgacattcttgcctgccgtgcgctttcaaccagaatatcggattttctggcagacagcgggcaaccttctgacagcaccgtggttttatgcataggaaccgaccgcgctaccggtgatgctctcggccctctgacaggcagctttctgacagagcacaactgtcctttcaaagtatacggaacgttaaaagctccggtccacgccctcaatctgcgcgataccatacaccatatatacgaccattttgtctcccccgccatcatcgccgtcgacgcatcccttggacgtccttcagatgtaggtatgatcacgctctctaacgcccccctgtaccccggaatcggtgtaaataaaaaactcccggcgataggagatatctccatcaccgggattgtaaatctgtctggaaagccaggtatgagtcttcttcagagcaccaggctgtataccgtcagcaatatggcacgcttcatctctgacgccatactgtcatcatcgacacactga

SEQ ID NO: 1805 - DNA, 516 bp, Coprococcus sp.
gaggtagatgaaatgagtttattaaaagaatggcgtgattacgcatacggattagatgacagaacacctgagggaaaggaattctgggttagttatttccaggcagagaagggcgtatatgagcagcttcttgctaatcctcttgcagaccctgtacatggaactgtaaaagagcttgctgagaagtacggactcactattcagtatatgatcggattcctcgacggaatagatgacagtcttgcagaatcaaacaatcttgatgatgtgacagaggactcagaggttaagcttcctatagattatgagaagctttatatgaacatggttgagtgcaatgcagagtggctctacactcttcctcagtgggatggaatattctccaaggcaaagagagacgagctctacaagatacagaagtcatctaagactatcatcaaggcaccaaaggttggaagaaacgatccatgtccatgtggaagcggacttaagtacaagaagtgctgcggtaagtaa

SEQ ID NO: 1806 - DNA, 408 bp, Coprococcus sp.
gtggagaatagtaatcaaaaaggagatcagagaatgaattcactttcaacaattttatcatcgtcaacaggaacacaggccagtggcggttcatcagttatgtttattgttgtatatattgccatatttgctgcaatcatttacttcatgatgatcagaccacagaagaagcagaaggccaagacagaccagatgctttcacagatggagcctggtgataatatcatgacaaccagtggtttctacggaaccatccttgatgtggttgatgattcaactatcatcgtagagtttggtaacaacaagaactgtcgtataccgatgcacaagagcgctgttgcagagcttgagaagcagggatcatcaacagtcacagatgatgataaggataagaagtcaaagatataa

SEQ ID NO: 1807 - DNA, 462 bp, Coprococcus sp.
atgaataaggtagaaggaaagttagtagcaaatggagcaaagataggtatagtagcagcgagattcaatgagttcatagtttcaaagctcgtcagcggtgcagaggatgcgcttctccgtcatgatgtgaatgcagacgacatcacagttgcatgggttccgggtgcatttgagatccctgtaatcgcaaagaagatggctgcaagcggcaagtatgacgctgttatctgtcttggtgctgttatccgtggtgcgacaagccactatgattatgtgtgcaacgaggtttcaaagggcgttgcctcagtatcacttgagacaggtgtacctgtaatgttcggagttgttacaacagagaatatcgagcaggccatcgagcgtgcaggaacaaaggccggcaacaagggttatgactgcgctatgggagctcttgagatgatcgacctcatgaagcagttgtaa

SEQ ID NO: 1808 - DNA, 384 bp, Coprococcus sp.
gtgcagataggagatgatatcatgggatgtcttggaaattgtatatggtttttatgtggcggaatattgagcggactttcgtgggtggcaagcggggtgctgtgctgtataacgataatagggattccgattgggatgcagtgctttaagtttgcaggacttgcattctttccatttggaaaagagatagtgtatggaggcggggctggctcgctgatcgcgaatatcatatggctgctctgctgcggaatacctatggcggtagagaatgcctgcctggggctgctgctttgcataacgatagtcggaattccatttgggcttcagttctttaagatcgccaaactgtcgctcatgccgtttggtgcagagattgtgggatga

SEQ ID NO: 1809 - DNA, 420 bp, Coprococcus sp.
atgattcacattattgcaggagataagggtaagggaaagacaaaggcactgatagataaggtcaacaatgaagtaaaggttgtttccggtacggtagtatttcttgataataacaacaagcatctctatgagctcagcaacagagtcaagatgatcaactgtacaagctatggaattagcaagctggattcgttcaccggattcgtgcgaggaataatctcccagaacagtgatattgagaagatttatatagataattttaagacggttgcatacgttggagagtcacatatcgttgaggcattggacgagataaagaacatatccgatatgttcaatgttgatatagtgatctgtctggcaacagatgtcaatgacgtaccagaggatttcaaggactgcgttattgcggcattataa

SEQ ID NO: 1810 - DNA, 750 bp, Coprococcus sp.
atctttatatggattatggtagtatgtgtaagaaaaagggcaaaaaagcctgaaaacaggaggattcgcagagacatggaacagtacaagaaggaatttatcgaatttatgattgactgtaacgtactcaagtttggagatttcgttacaaagagtggaagaaagacaccattttttgtcaatacaggcttttacagaacaggtgcccagctcaagaggcttggcgagtattatgctgaggctataaatgcagagtttggtctggactttgatgtgttatttggtcctgcatacaagggaatacctctcacagttgcgacaactatgtccatagcagagatgtacgatgaggacatcaagtattgctcaaacagaaaagaggtaaaggatcacggcgacaagggaatactccttggaagtcctatagaggatggcgataaggttgtcatcatcgaggatgtcacaacagccggaacatctattcaggagacacttcctatcatcaaggcacagggcgacgtggatgtcatgggtcttgtggtttcagtagacagaatggagagaggccagggcgagaagagtgcgctgacagagatcgaggagaactacggaatcaagacaacagctatcgtaacaatggcagaggtagtggagcatctttacaacagagagtataagggaagagttatcatagatgacacccttaaggccgctatcgacgcttactacgatcagtacggtgtaaagtag

SEQ ID NO: 1811 - DNA, 834 bp, Coprococcus sp.
gctataacagttgttctgtggttggtaaacttcgtacctcagatccttctcgcacttgttcttgctgcctggttcacagacatcaaggttaagataaagggtcagggtgtattcaaggtaatcatgtacatgcctaacatcattacagcagctacaatcgccgttctcttctacggtatgttcgaggttcagggacctatcacgagcctgttcagaagttggggatggtgtgatgagggtggtatcctgaatcatggctgggcatcacttataatcattgcttttatccagttctggatgtggtatggtaatacaatgatcgtcctttgtgcaggtattctcggtatcaatccatcactttacgaggcagccagtgttgatggtgctacatcaaagcagcagttctttaagataacacttccactgctcaagccgatcttacagtacacacttgtaacatcagctatcggtggtctgcagatgtacgatattccacagctcttcaacgaaggtaacccggttgtaagagtaggtggatcagatgtcaattctacaacaacagtagttatgcttatcaagaagtacgtaagtgcaggtcctacacaggattatggtaaagctgcagcttactcagtaatgcttttcgcattcacattgattataagcttactgttctacaagctgacatcagagaaaacagaaaaacaaggaaagcaggtgaacaaagttggatcagacagaatcaaaagcaacgggaacgagggttttaagatatgtcatctgtatcatactttgtttcctgtcaatcataccgttttatattttgttaattaa

SEQ ID NO: 1812 - DNA, 546 bp, Coprococcus sp.
cttgacaggagtgatagtagaatgaatttaccaaacaaattgacaatactaagagctataatgattccattctttctcgtgtttttatatatgtcaccgggatggtcgaagtgggtggcacttggaatattcatagccgcatcacttacagatatgcttgacggaaagattgcaagaaaatacaatctggtcaccaattttggaaaattcatggatcctctggcagataagctgctggtatgttcggcactcatagcactgtcggatctgaacaggatcccagcatggatcgttatagtgatcatagcgcgtgatttcataataagcggattcagacttattgcggcagaaaagggaattgttattgctgccggatggtggggaaagatcaagacaacggttcagatgatcatggtaggatttctgatagctgatctcaaggtgttctacatctttgatcaggtgctcatctaccttgcacttgcactgacacttatatctcttggagattatctgtatcacaacagagaagtcctcaaggactaa

SEQ ID NO: 1813 - DNA, 288 bp, Coprococcus sp.
atgaagagtagtgacgtaatcttagttaaaggcgatgcaacagaagagaaggcaaagagcacattatttgtgatcttggttatcattggtgccgttgctgctattgcaggtattgcatatgcagtatattcatatcttacaccagacttccttgatgattttgatgatgacttcgacgatgatttcgacgatgacttcttcgatgatgaggaagatacagatgaggcagagccagcagcagaagcagccgaggcggcagacgcagccgaggcggcagacgctgagtaa

SEQ ID NO: 1814 - DNA, 531 bp, Coprococcus sp.
agtcagagtgcgggggacttcctcagtgctctgagtgcgggaaaagataggagaagagaagaaaagacaggaggagtcagatatatggatgacaatggatctatagttctggagatgtgcctgataacaccgatacttgtgtgtgccgtgtttgtggtgatgaacatgttgtttatagcgtttaaccatgcggcggcatcgggggaggcatatctggtactgtacaaccgagaggaatacaggatcaatgagagtggtgagggggatacggacagtgcagagaaagcgatgtccacaaatgtatccgagaccgtgatatgtgccgatggtgtgaatgcggaaatggccatgaatgggaagaatctggttgcggagataacttacagagagtcatttccggggatacagatattgatagatgacggcagatgtgacagaaagactgcggccagacaggagataagggatgtaggaaatgaacttaggaggtggcaggaatatggtaagttattgccaggtagagggaattaa

SEQ ID NO: 1815 - DNA, 360 bp, Coprococcus sp.
aaaagcataataaatataaaaaagtgcagaataaacaggagaagatatatgtttgcatcaatagacgaagcggttgaatactggaaggacgagctgtcatatgtggacgacgcaaaggtgacaggatatgtgggaggctacccggtggtggaatttaccatcaacaaagccgcctggggacttgttaaggacaagaagaaatttggaaggatcgtaagatcatcggagatggagggcggaatagaagtcggtgtgtcgacatgcttttatcagacggcatccctggagtgggagccacctgtcctcagggtatgcggatatcctgaagtgatcaacagaatacttggcaaggtaatgtaa

SEQ ID NO: 1816 - DNA, 462 bp, Coprococcus sp.
atgtcagagttaggatgccgttacgccatcctgccgcccatttctgactttaggagaaatcacatggatataaacatatacgttaatcagaaaaaaatcaaccctttgtatcagaaagccatcgccgagtacgtcaagagactttctccatactgtactctgtctatagtatgtgttgcagggaaaattaaatgcacctcagggaaaaacaccacaaactactgcatatccggctccgataccatctcatctgaggactacgcagcccgcatcaacagtctgacttcaagcggtacctcaaagataaacttctacatagggtacgatgaatcactcacagctgatatggaaaatttctctctctgttcagtacagccgtccgtcgagatgactgccctcctgctgtccgagcagacctacagggcatacactatcctgaacaacataacctaccacaaataa

SEQ ID NO: 1817 - DNA, 972 bp, Coprococcus sp.
atgattcatataaaggacacgaagaaggtaaaactgaatagcacagagcgcacggcggttgccctgggcaagtttgatggtatccatcagggacacatgctgttgatagagcaggtgttgaagcttcagagacagggatatatgggcgttgtgttcacatttgacatgagggagaatcatgtgtttgatgtgagcaatatgaagaccatatacacatctgacgagaaggcacaggtggtatcggataccggagttgacgtcctggttgaatatccgtttgacgatgcatttgcggctacagagccgaaggcgttcatcagagatgttctggtggacatgatgcgggccggatatgtcgtggttggaagcgattacagattcggcagagacagaaagggcgatgtggataccctcagaagctatgcggacgagtatggatataaggtcatagtcatagacaagctggaacaggatgacgaggtggtcagctcaactgtcatcaggaagaatatttctgagggagatgtgaggtcggtcattccgatgctcggcagaccgtacagtatgacaggtgaagtggtgtccggtaaacagcttggaaggacaataggaataccgactgcgaatatgctgcctgaggagcgcaagctgtacccgccggctggtgtgtatgcttcaaggatcaggataatccgggggaagcatacgggacatgaggatcctttcagagtctatatgggaatcaccaacataggagacaatcctacagtcaacgacaagggaaatatcaccatagagacgaatatcttcgactttgacaggaacatatatggacagatcatcaaggtggagcttatcgagcagatccgaggtgagaagaaatttggaagcctggatgagctcaaggcccagatggcaaatgacatagaaacttcaaaaagaatacttgctaaaaaagtattggtaaaatag

SEQ ID NO: 1818 - DNA, 558 bp, Coprococcus sp.
caaccggctgtgctggtacgattagatgggaggcaggacatggttaaggcgataggaggctgtctgatcgtatatgcctcatttatggtgggacatgccatagggcagttgcatgggtgcatggtgaaggagatggaggaaatgctgctcttcatacaactgttcaaggggcagatcatgtatgccggatcggagctcccggagatactcgccgacagtgcaaagcgtctcaagggaaatgttggtaaatgggtgaacggtctggcggagatgtctgagaagaacagggacaggccatttgcagaattgtggacagactcactggcgatgctgaggcgggacagtgccttgagcttggaggtgctggcggatgtggacaggcttggaaagataatgggagatatggacgttgaggcacagctctcaaggataaatcttgtggaagatataattacggacagataccagcgggaacgcgccagaagttccgggataaagaggcttgccaattcacttgggctgcttggaggcgtattcatagttatattgctcatgtag

SEQ ID NO: 1819 - DNA, 756 bp, Coprococcus sp.
ttgttcacaaatagcggaggtacagatttgaaaacagcgataataattggcgcctcgacaggcatcggaagggcgacagcactggcgctttcaggcaaatataacagcatatctatcacttcattcaaacacaaagaagagcttctctctctgagagacgaacttatggcaaaaggctgcatctgttactgtgagaccggagacgccggggatatggaatttatggagaagtttatacaaaataccatagatcatctcggcagcgacatcgatctcctcatcaacaatgccggcatatcttatgtggggcttataaacgatatgaccgcacaggattttgacagaaccatgaagtcaaatgtgtactcggttttcaatagctgccgactcgtggttcctcacatgatccagcaccacaaaggacacataatcaatatctcatccgtgtggggaaatgtcggtgcgtcgtgtgaggtcgcatattcagcctccaagggtgctgtaaattccttctcaaaggctcttggaaaagagcttgctccaagcggtataactgtcaacgccatagcatttggcgcaattgacacctccatgaacggtcatctgtcaccggaggaacgccagatgctagaggatgaaatacctgcaggaagaatggccataccttctgaagcggcagatttcattgtgcacattgccgagtgtggagaatacctgaatggtcaggtgatcacatttgatggcgcatggcaatag

SEQ ID NO: 1820 - DNA, 795 bp, Coprococcus sp.
ttggaagatcaggaaggaaaaaagggcatgttatttgctattgatgctggaaatacaaatattacgataggactgtttgacggagaacgcctggagaagaccttcaggatgaccaccgggatatcgagaacatcggatgagtacggagtatttctgtgcgactggctcagaatgagacagttgtcaactgatgttatagatgaagttataatcgcttcggttgttccgaagatcatgcattccctggtgaatggcataaagaaatattttggaataacaccactcatagttgagccgggaataaagacggggatcaatatagcgctgccaaacccgaagcagcttggagctgacagaatagttgacgcagttgcggcttatcacatgtatggcggaccggttctcacggtggactttggaactgccacaacgtacgacctcatcaatgccgatggcgtgtttgaggctgaggtcacatcaccgggtataaggcttattgcaaatgctctgtggacgggaacagccaagcttcctgagatagagataaaggtgcctgagacgatactgtgcaaggacacgatatccagtatgcaggccggtgtgtgcatgggctatattggccagacagagtatatagtgaagagaatgcgcaaggagtcaggatacgacaacatgaaggtcgtggctaccggcggacttggaaagatgatatatgagaacacggactgcatagatgtgtatgatccggatctcacacttcacggactcagacttatcatggacaagcagaaataa

SEQ ID NO: 1821 - DNA, 402 bp, Coprococcus sp.
atgaaaccacattcatccaatccactacctgcccttctcagatatttcagacagaaggcaggactcacacagcaggatgtcgcagcagcgctatctatttccagatccggatatgccaactacgaggaagggagaaacatccctaatatagaacaggccataaagctgtcagagcttctcaaccacgattttctatatgcatacaccctgtcatcaagatacatgcaggggcatccaaagccactacagatcgtcatggaggacaattcatacatgaccgccatagaatctaaccagagcacagcagacatgctgggcaattacagatctctcagcgacagcgaccgtcaacttatagacacatttgtggcaaatctagcatctaaaaattccagactgtaa

SEQ ID NO: 1822 - DNA, 543 bp, Coprococcus sp.
agaggagatttcttacaccgccaaggtttttataggaggagtagtatgctaaatatagtattacatgagccggagatcccggccaatacaggcaacataggaagaacatgtgtggcagcaggcgcaagactgcatctcatagagccgctgggcttccagataaatgagaaacagctgaagcgtgccgggcttgattactgggacaagctggatgtgacaacgtatgtgaatttcgaggatttccttgcaaagaatcccggagcaaagatatacatggcgacaaccaaagccaggaagaagtatacagatgtgaagtttgaggatgacgcatacatcatgttcggcaaggagagcgcgggtatacctgaggagatcctggttgattataaggatacatctatcaggattccgatgttcccagacattcgttcactgaatctgggcaactctgtggcaatagtgctgtatgaagcactcagacagaatgatttcccaggtctagaggaagcgggaaatctacatcgtcttagttgggacatgtag

SEQ ID NO: 1823 - DNA, 540 bp, Coprococcus sp.
atgggatatgtgaatagagacttagatgatcaggaggtattgtttatgtggagaatgttcagggcggccatactgggtgtcctcataggaattgtcggcggtgtgatatttggacaggtttcttatgtgaagaaatataaggataaggtgtcgagggagataatggcggatgcggtcatgtacaacaattcactggatgacagtggaagggtcataaggcttaaggtcgattatgatggcgatatgaagtctgaggatgagagagatgagcttgagagctatgtgggcaacacagtcatgaagcagatcggcatgtggcttggggacgactacaatgagaatctgagttatatacagatgcgccacaatcttgtcatggcgatggaggatataaatgacattgcccagagcgcggcaaatgcgtggggcgtggatgccgatgcaaactccggattttcttatgagtattttggcgattccggggaggactgtccgcccggaatgtatgagacattatgtatagatctgggggataagtga

SEQ ID NO: 1824 - DNA, 627 bp, Coprococcus sp.
atgaaggtagaatcacttatatttgacatggatggaactctgtgggacagcgcggcaaatgtggctgcgtcctggagtgaagtcctcgaaagacaggctgatgtggacatgaaggtgacagaggccgatatcaaatctgttatgggtatgcctatggatgccattgccgacaagctgttcggagcgtattcggaggacagaatgactcagcttatagatgcctgcggagactatgagaacgagtatctccgtgaacatggcggcgttctgtacgatggtgtagaggataccattgcgaagctttcgggatcacacaggctgtttatagtcagcaactgccagagtggatatatagaggcatttcttgattattacgggtttggaaagtattttaaggatatactctgctggggagatacaaaggtatcaaagggcgagagtataaagatactcatggagaagaatggaatagaggatgctgcatatgtcggcgacatccagggcgactgcgacagtgccagatttgccgggataaagttcattcacgcggcatacgggtttggcagtgtgaaggataaggatgcggagatccatacatttgcggaacttcttgacgtggtggagtga

SEQ ID NO: 1825 - DNA, 444 bp, Coprococcus sp.
atgaaaaaaagaaaagaacgcaacattgatccgtcggtgtatgaagacgattcatccgatcaggattttaactgtgcagtgataggcggcgcactgaagtctctaaggcgcagccacggaaaaaggcagcaggaaatagccgccatcttgaaggtgtccgtctccgcctactcgcactatgaatgtggagagcgaatcccggatctcataaatcttatcagaatatccaatttatacagtattaatatgagtcatctggtgctgctcacctgcatcgatatagcaaagaaaaataagatggacatcagcgaagtgttcctcgcctacagccacggcaggactcttccaccggaagcgacaggaataatgtccgactgtgatcagcttgacgacaacggcagggaaaatctcaggctgtttttaaagtctgcactgagctgctag

SEQ ID NO: 1826 - DNA, 1161 bp, Faecalibacterium sp.
atgtataccatcaaaacactgaacaacatcgcccccgcggggctggcgaagctgggcccggcccagttcaaagtggataacgaggccgacgcgccccagggcattctggtgcgcagcgccaagatgcacgagatggagctgcccgagagcctgctggccatcggccgcgcgggcgcgggggtgaacaacatcccggtggaaaaatgcagcgaggcgggcgtggtggtgttcaacacccccggcgcaaacgccggcggcgttgccgagctgaccatcggcggcctggtgctggccagccgcaacctgctgcccgccatggagtgggcccagagccttgccggcgagggcgacgcggtgcccgccctggtggagaagggcaagagccagttcgtgggcccggagcttgcgggcaaaaagctgggcgtggtgggccttggcgccatcggcgtgaaggtggccaacgcggcggtgcatctgggcatggaggtctttggctacgacccctacatctcggtgcaggcggcctggaacctgagccgcggcgtgcgccacagcgtgagcctgaccgagctggtggcccagtgcgactacatcaccctgcatctgcccgccaacgcccagaccaagggcttcatgaacgcgggggtgttccgggcctgcaagccggggctgcgcctgttgaacttcgcccgcggcgagctggtgaacaacgccgacctgctggcagccctggccgagggccagctggccgcctatgtcaccgacttccccgccgccgagctgctgggtgtgccgggcgtcacctgcatccctcatctgggcgcttccacccccgagagcgaagagaactgcgccgtgatggccgccagccagctggcggactacctgctgaacggcaacatcgtaaacagcgtgaacatgccggaagtggtgcaggcaagggccgcgggcaggcgggtgtgcgtcatccacaaaaacgagccgggccttatcagcgccatcaccgccgtcatcaccgagagccggctgaacatcgagaacatggtgaacaagagcaaaaaagaaatggcctacaccatgctggacgtcaccggcggcatggacgccgccctggccgaccagctggccgccatcccctcggtcatccgggtgcgggtgctg

SEQ ID NO: 1827 - DNA, 948 bp, Faecalibacterium sp.
gccggccttttttccgcccgccgcgccgcccggatttggtatgagaatatttcatactttgcaccgggcgcatttgatggtagcctaagaatagaaaatgacgcgccgcgccgcgctatctttgcaaaaggaggaagaaaaaccgctatgttcagttcgaaaaagaaaaccggcttttccaagttcgtagcgtccattcccaatggggtctggatcgtcatttcgctggctgccgcgctgcttttgtgggtcgtcatctcccacaccgaaaaaggcggcgtcgtgttcgccactccccccgaggtggtggagagcctgatcagcaagatccaggacggcaccctgctcacccacatcggccacagcctgttccgcgtgatcgtgggcttcagcctgggctttgtggcttccatccccgtggccttcctgatgggctggtacgcccccttccgccatgtggtggagccctggatccagttcgtgcgtaacattccgccccttgcctacatccctctggtcatcgttggcgccggcgttggcgagccctccaagatcatcgtgatcttcatcgcctgcttcctggtgctggtggtcaccatctaccagggcgtgtgcaacgtggacgtcaccctcatcaaggccgcccgcatcctgggcgccaccgaccgtgacatcttcttccgggtggtcattcccgcttccacccccttcatcctcaccggcgcccgtctgggcctgtccgccgcgctgaccaccctggtggccgccgagctgaccggcgcttccgagggcctgggcatgatgatccagaaggccagcggctactacgacatgggcaccgtgctcatgggcatcatcgtcatcggcatcatcggcatctccatggagaagctggttcggttcttagagaggaggctcacaggatggcaggaaacagtgcagcagtaa

SEQ ID NO: 1828 - DNA, 900 bp, Faecalibacterium sp.
gtgaagatcgcttcgtttgaacagatggaagcctttgtgaagggccacgccagccgcaagaagatcgccgtggcctgcgcccacgacgacgtcaccctggaagcggtgctgatggccgtggacaagggcgtggccgacgcggtgctcatcggcaagcaggatgagatcgaggcgctgctgcggcagttcggcaaggaccccgccgccttcgagatcatcgacgaggccgacgagcgggccgccatcgacaaggcagtggccatggtgcgcgagggcacggcggacatccccatgaagggcctgatgcacaccgccaccttcatgcggggcatcctggacaagcagaccggccttctggagccgggcgagctgctgagccaggcctcggtgttcgaggtggaggagaccggcaagatgctcatcatcagcgactgcgccgtgaacatcgagcccaatgtggaccagaagtgcaagatcgtggagaacgccgtgaaggtggccgggtccctgggcatcgaagagcccaagatcgccatgctctcggcgctggaagtggtgaacccgaaaattcagggcacggtggacgccgccgaggtgactgcccgcctgaaggataaataccagatcgacggccccttcgcgctggacaacgccgtcagcgtggaggccgccaagcacaagggcatcgacagccccatcgccggcagggcggacatcctcatcgtgccggacatgtggagcggcaacatcttcaccaagggccttgtgttcttcgcccatatgaagagcgccggcaccctgaacggcctgcgcagcccggtggtgatgaccagccgcaccgacaccatcgaaaacaagtactactccattctcacttcggtgctgggcaccatccaatga

SEQ ID NO: 1829 - DNA, 1332 bp, Faecalibacterium sp.
atcctcatcatcctgctgatgccgcccctcggggtggtgttctatctcttctgggggcaccgcaacaccaccaaccgccacgcgcggcggatgaactccatctgcgcgcgcctcagccgcaccctgccccaggacccgaaggccctgcaccggctggaagtgcaggacgagagccttgcccgcagcgcccgctatctcatccgcaacgcgggcgcgcccctctacgccgacacccagagcgaatattacgcctggggcgaggagttcttcccccgctttctggaagagctgaaaaaggccgagcgcttcatcttcatggagtatttcatcctgaaacccggctacatgtgggacaccaccctggaaattctgaaagagaaggccgccgccgggctggacgtgcgccttttgtacgacagctggggctgcatgctcaccatgccggaggactatgacgagcagctgcgggagtggggcatccagtgccaccgcttctcccccttccgcctgtcggcccacatctccgactacaccatgttcaaccaccgggaccaccgcaagatcaccgtcatcgacggcaacgtgggcttcatcggcgggctgaacttcgcggacgaatacatcaaccgcaaaaagcgtttcggcgtttggaaggacaccggcctgatgctgcggggcagcggcgtttacaacctcaccgccctgtttttggagagctgggacttcaccaccggtgagtccagccggctggaacagttcgcccccaccctgcgcttttccgccgacggcatggtgcagccctacggcgactcgcccctggacgaggaggcggtggcggagaacgtctacttcaacatcctccagcaggccaccgactacgtctacatcgccaccccctatctggtggtggacaacgagatgataacgaccctgagcctcatcgccaagagcggcgtggacgtgcgcatcatcaccccgggcatcccggacaagaaatacgtctactgggtgacccagagctactactcggtgctgatgaaggcaggggtgcgcatctttgaatacagccccggcttcatccacgccaagatgtatgtgtcggacgacaagaccgccgtggtgggcagcgccaacatggactaccgcagcctctacctccactttgagaactgctgcgtgttctacggcgggcacatggtgcaggacgtgcacgccgaccttttgcgctgcatgcaggtgagccacgaggtcacctgggaggacgtgaagaacgtgccgctgcccaagcggatcttccgggtcatcctgcggctgttcgcgccgcttttgtga

SEQ ID NO: 1830 - DNA, 588 bp, Faecalibacterium sp.
ccctggttccatctggccgtggtggcggcttctccccgttcggcgggcaagacctacgaagaggccgttggcagccgctgggccatgcctgaccccatgccggagcaggtcaagaatatggtggtgcttgatgcctcccatgtggaagaagtggcctccaaagtcgatttcgtgttctgcgcggtggatatgaagaaagaggagatccgcgcgctggaagagagctacgccaaggcggaatgcccggtggtctccaacaacagcgcccaccgcttcacccctgacgtgcccatggtggtgccggagatcaaccccgagcacctggacgtcattgcagcccagcgcgcgcgcctgggcaccaaaaagggatttgtggcggtgaaatccaactgctccctgcagagctatgtgcccgccctgcaccccctgaaagacgaattcggcctttccaaagtgctggtgtgcacctatcaggcaatctccggcgccggcaagacctttgccacctggccggagatggtggacaactgcatcccctacatcggcggcgaagaggaaaaaagcgagcaggagccgctgaagctgtgg

SEQ ID NO: 1831 - DNA, 1098 bp, Faecalibacterium sp.
atgccggtgggcatcagcttcttcgtgttcaagaacatcacctatctggtggcggtgtacaaggggagccttgccgccgagaagaaccccctctactgctttgcctacaccggctttttcgcccagctcaccagcgggcccatccagcgggcggagagcctgctgccccagctgaaaagcccgcccgcctttgaccgggcgctggcgctgaacggctgcgtgcggctgtgctggggcatctttctgaaaaagtgccttgcggaccattttgccgcctactacaacgccctttaccagccggaccactactacgccttgagcatcgtctggtcgctggcggcctattctctctacatctatttcgacttcgccagctattcccagctgtccatcggcgtggcgaacctgctgggcctgcgctgtgacgagaacttcctcagcccctacctctcccgcagcgtgggcgagttctggcggcgctggcacatcagcctttccagctttctgcgagactacatctacatccccctgggcggcagccgcaacggcgtgccggtgctcatcctcgccaccatggtcaccttccttgtgtccggcgcgtggcacggcgcggcgctgggcttcgtggtctggggcgggctgcacggcgtttacctgctggccgggcgggccacccgcggcgtgcgggaaaaggcctggggccttctgcgccagaagccggacagcccggtgcgcagcgtggtgagctgggccgtgaccctggtgctggtctgctttgcctggatcttcttcttcagcggcgatgtaaaccaggtgcggctgctgatgagctatctgctccagcccatgcccctcagcgcccagtacctgaaagagagcttcacccagctgggctacaccaccgccgttctggtgcggctgggcctgttcgccctggcggccttcggcgtggactttgccgcccgcaaagagggcttcggccgctgggccgccgcccgcaagggctgggtgcaggtgatcttctgctacgcctgcatcttcgccaccctgttctggggcgcggcgggcaccttgcagaacatctatttccagttttaa

SEQ ID NO: 1832 - DNA, 858 bp, Faecalibacterium sp.
cgcgccgcggtggatttcttcgccgccctggacggggtgctggcgcagcacttcgcccactatgaactcatcgcggtgaacgacggctgcaccgacgacacggtgcccgccctgaaagcctgggccgccgagcacctggaagcgcccctgacggtggtgaacatgagcctgcgccagggcgtggaaaaggcgatgaacgccggcctcgacgccgccatcggcgactttgtgttcgagttcgaccgcccggcgatgggctacgacccggacctcatctggcaggcctatcagaaagccctcaccggctttgacgtggtcaccgtctgccccagccgccagcggctgatgagcagggccttctaccgggtgttcaacaagttcagcaacagcccctacaagctctccaccgacgcgttccggctggtgagccgccgggccgtcaaccgggtgaaggccatcagcgacgatctggcctaccgcaaggcggcctatgccgccagcggccttgcctgcgccagcctgacctttgagggcacggcggcgaaggacgacgagccccgcctggacaaagcggtggacagcctcgccctctacaccgacgcgggctacaagctgagccttggcatcagcatggggatgatggtgctcacgatggtggccttggtctacacggtggcggtgttctgcctggggcagcccatcgccggctggaccaccaccatgctggtgctttcggcggggctctccggcctgttcttcatcctcaccatcgcggtgaagtatctgaacctgctggtgcgcctcacctttaaaaagcagagctacctcatcgagggcgtggagaaactgcaaaaataa

SEQ ID NO: 1833 - DNA, 759 bp, Faecalibacterium sp.
atcccccccgaactggaaaagcagtacgacatcgacatcctgccctttgtcatcacactggacggcgtgagctatgtggagcgccgggacttcggctttgacgaattttatcagatgctgcgctccgcccagggcgtgcccagcaccgcgcaggtcaccgccatccagttctgcgagcagtactgcaaatacgtggacgagggctacaccgacgtggtgcatgtgaccatcaactccaccggcagcggcacctatgacgcggcggtgctggcgcagaacatgctgcgggaggagcgccccgaccacaaactgaacatccacctgatcgacagccacacctattcctacgtgtacggcgcgccggtggtgcaggcggcccgccgcctgcgcaacggggccgaggtgggctatgtgtgcgccgagctggaggccgcctttgcccggcaggagatcgtgctctccgccttcagcctcaagcagatgaagaagagcggccgcatcagcgcggcggcggcctttgccggcgagctgctgggcctgcggcccatcatcagcctcatcgacggggtgaccaaggtggaggacaaggtgcgcggcgacgcggccgtgcccgccgccatgatcaagcaggtgcgcaagcggatggactatcccgacggggacgttcactacatgctgggctgcaccgacatccccaacgtgaaggagctggagaagctctgccgcaaggagttcggccgcgggccggacgcggtgttc

SEQ ID NO: 1834 - DNA, 762 bp, Faecalibacterium sp.
gtgggcaagatcattgcggttgcgaaccaaaagggcggcgtgggcaaaagcaccacggcggtcaatctggcggcctgtgtggccgcccaggacaaaaaagtcctcattgtggacctggacccccagggcaacaccaccagcggcttcggcgtctccaagaaaaatgtggaggccagcgtctacgagctgctcatcggggaggccaaggccgccgacgccattcttcccacccagttcaaggtggacatcatcccctccaacatccagctgtccggcgcggtggtggagctggtgaatatgcccaagagtgagagccgcctgcggcaggcgctggcccaggtggccggcaactacgacttcatcttcatcgactgcccgcccagcctggacctgctcaccctcaacggcctgtgcgcctgcgactcggtgctcatccccatccagtgcgagttctacgccctggagggcctgtccgagctgatgagcaccctcaagaccgtgcgcaagatgtacaaccactaccttgagatcgagggcgtggtgttcaccatgtacgccggccgcctgaacctcaccctgcaggtggtggagcaggtgaaaaagttcttcggggacaaggtctacaagaccaccgtgccccggaacgtgcggctctccgaagcgcccagcttcggcatgcccatcaattactacgacccggtgagcaagggaaacgaggcctacatggaaatggccagggagttccttgcaaacaaccggtaa

SEQ ID NO: 1835 - DNA, 381 bp, Faecalibacterium sp.
atgcaggtccatgaatcctcggaggattatctcgaggccatcctgatgctgaaagagcgcaagggctacgtgcgctcggtggacgtggccaacgaacttgccttcaccaaagccagcgtgagcgtggcgatgaaaaagctgcgggagaacggctacgtgcaggtggacgccgacggcgggctggtgctgaccgaggcggggctggccattgcccggcgggtgtatgaccggcaccggctgctcaccgagttcttcgtgcggctgggggtggacccggaagtggccgcccgggacgcctgccgcgtggagcacgacctgagcgagcagactttttcgaagcttgtggaacacgcgcaaaaaaagtttgaaaaagatggttga

SEQ ID NO: 1836 - DNA, 1755 bp, Faecalibacterium sp.
gtgaaaaaactcttcgcccgggcggcggcgtccctctcggggcgctaccgcaccatgagcatccagatggtcatctccctgtccttcaccgcggccgcggtggcgggcatggtgctcatgggcctgagccttgtctggcgctactccgcgggcaccgagcagctggtgcgggagaacaccgagcgggtgctgggccaggtgaacatgaacatggacagctacctgcgccggatgatgcgggtgagcgacaccatgtattaccgcatcatcaaaaacgccgaccttgccacccagagcctggacgaggggatggagctgctgtacgaggagaaccgggacgagctggtctccatcgccgtgttcgacagcaggggcgcgctggtggcgggcacccccctcaccgccctgaaggaaggggcggaccccgcctcctccgactggtatcaggcggcgctggacaagatggagaacctgcacttttccaccccccacatccagcacctgttcgccgacccggacgacagcttccgctgggtggtgtccctgagccggtatgtgcagctcacaagagagggcagcacctacagcggcgttttgctggtggacatgggcttttccggcatcgagcaggtctgccgggacgtggagctggcgggcggcggctacatctacctcaccgacgcgtccggcgaactcatctaccacccccgccagcagctcatctacgcggggctggacaccgagaacaatctggccgccgcgtccctggccgacggcacccacaccgagaccttccagggggaaagaagactggtcaccgtcaagacggtgggctacaccggctggaagctggtgggcgtggtgccccgcaccggcgcgggggacgacgggggctacatcttcctgttcggcctgtccatgctgctgttctcggcctttttgatggcctttctgaacttccgcatctcggcgcgcatctccgaccccatccgccggctggagcagtcggtgaaggagttggaggccggggcccaggaggtggccatccgggaggacggctgctacgaagtgcggcggctggcccactccatcgcgtcgatggtgtccaccatgcgccacctgatggacgacatcattttgcaggaaaagcgcaagcgccgcagcgagctggaagtgctgcaaagccagatcaacccccatttcctctataacaccctggactcggtgatctggatgaccgaggccggccgctacgacgaggccatccagatggtcacctcgctggcgcggctgttccgcatcgccctcagccgcgggcgcagcttcatccccctggcggacgaactggagcacgcccgccactacatgaccatccagcagatccgctatcaggacaagttcaccgccgccgtgagcgccggggagggcaccgaggggctttacaccctcaagctcatcgtgcagcccctgctggagaacgccatctaccacggcatggccggctgcgaggaggacgggcgcatcaccgtcaccgcaaagcgggagggcggtgatctggtcatcgacgtgagcgacaacggcgtgggcatgccccccgaggtggtggagcgccttctggacgagagccagccccagacccggtccagcgggtcgggcatcggggtgcgcaacgtccaccggcgcatccggctgaccttcggcgaaggctacggccttgaggtgttcagcgagccggacgagggcaccaccgtgcgc

SEQ ID NO: 1837 - DNA, 978 bp, Faecalibacterium sp.
atggaacttctcatcgtgggcctgggcagcatgggcaagcgccgcgcccggcttttgaagggcatcgacaaaaacatcgccctctttggggtggacaccagcccctcccgccgggaggaggccgcggctctcggggtggaaggcttcgagagcatcgacgcggcgctggcggcaaaaaaattcgacggcgcgctggtgtgcaccgcgcccctctcccacgcggccatcatctggcagctgctggaagcgggcctgccggtgttcaccgagctgaatctggtcagcgacggctatgccgagaacatggcgctggcaaaggaaaagggcgtgcccctgttcctttcttccaccatgctctaccggggcgagacccagtacatcaagagccgggtggacgcttttgaaaagccggtgaactacatctaccacatcggccagtacctgcccgactggcacccctgggagaactacaagaacttcttcgtgggcgacgcgcgcaccggcggcgtgcgggaaattttcggcatcgacctgccctggctgctggacaccttcggcccggtgaagagcctgcacgcggaaaaggacaagctcagcgagctggagatttcctacccggacagcgtctttgtgaccctgcgccacgaaaacggcaccaagggcatgctggcggtggacgtggtgagccccaaggcggtgcgcaacttcgagtgctttggcgaagggctgcacctcttctgggagggcaaccccaagagtctttacgactttgaccacgccagcggcgagaagaaggccgtgaacacctacgccagcgtggagcacgactcccgttacagcgacaacatcgtggaaaacgcctacgtggacgagctgcagaacttcctcggcgtgctggcgggcagggaagaagcccgttacagcttcgaaaaggacctggagaccatccggctgatcgaggccatcgaggaggcgtga

SEQ ID NO: 1838 - DNA, 927 bp, Faecalibacterium sp.
atggaacggtttgacgtctttgttcccgcggagtgcgccggccagcgagccgaccgctttctcgccgacctggaagagatcgagctgacccgaagcgcgttgcagcgcctttttgagcaggggctggtgcagtgcggcgaaaaacctgtggcaaagaacctgaagctgaaagcgggcgaccacctgaccgtggacctgcccgacgcaaaaccgctggaggctcagccccagaacatccccttggagatcgtctatgaggacgactatctactggtggtgaacaagcccaagggcatggtggtgcatcccgcgcccggcagccccgacggcacgctggtgaacgcgctgctctaccactgcgcgggtcggctttcctccatcgggggcgtggtgcgccccggcattgtgcaccgcattgacaaggacaccagcggcctgctggtggtggccaaaaccgatgccgcccacgagggcctgtgcgcccagatggcggtgcacagtgtggagcgggtgtatgaggcggtggtctacgggcgcttcaaggagccggaaggctttgtggaggcgcccatcggccgccaccgcaccgaccgcaaaaaaatggcggtggtccctgatggaaagtacgcctatacgggatatcaggtgcttgcacagtataacggctttacacacattgcctgccgcttaaagacgggccgcacccatcagatccgggtgcacatggccagcatcggccacccgctggcgggcgacagcgtctatggcccgcgggacagcatcaagcggctgaacgggcaatgccttcacgcccgggtgctgggatttgaacaccctgttaccggcgaaacgatgcactttgaaagccctctgcccgattatttcacagactttcttcgcactctccgaaaggagccggaatcatga

SEQ ID NO: 1839 - DNA, 516 bp, Faecalibacterium sp.
atggatgaaaacaaacagctttggcagaaggccgcggactttcacggccatgtgtgtggcgggctgaccatcggctacaaggcggcgctttacgccatcgaactgctgggcatcgaaatggtggacggcgtgtgctccaaggacgaggagatcgtgtgcatcaccgagaacgacgcctgcggcgtggacgccatccaggccatcctcagctgcacggtgggcaagggcaaccttttgttccacatgcggggcaagcaggccttctccttctacaaccgcaagaacggccgttcggtgcggctggtgctgcgccccgccccggcgggcatgacccgggagcagtccttcgcttactaccaggcccacgagcccaaggaactgtttgacgtgaaggccgccacgctggcggtacccgagcgggccaagcttttcgactcctacgtgtgcgagaactgcggcgaagtgaccggcgccaactgggtgcgggtggcaaacggcaagcacctgtgcctggac

SEQ ID NO: 1840 - DNA, 1707 bp, Faecalibacterium sp.
gaaccccaacgtcagagcgtattcatcaaccgggagctgagctggctggattttgaccggcgcgtgctggccctgggcaaggaaaaaacggttccgctggcggagcggatgaagttcactgccatctacggcagcaatctggacgagtttttcatggtgcgggtgggctcgctctatgaccgcacgctgctgaaaaacgagatcaccgacaacaagaccaaactcaccgccgcccagcagctggcggccatcatgcccaagaccgccgacctgcagcagcagtgcgacaagatcgtggtaaagctgcgccagcatctggccgagcagggctatgtgcgcatcgatttccagaacctgaccaaagaggacgagcgcttttggaaaaagtatttcctgaatgagatgctgcccgtcctttcgcctcagatcatcgaccaccgccaccccttcccgttcttgcgcaaccaggaaatttacctctgcgcgaccctgaaggcaaagggcgatgacgcggtctcctatggtcttatccccatcagcagccagttcgaccgcatgctctacctgaaaaaggacgagcagctgctctacggtctggcggaggagcttatcctgcgctttgcggacctcgttttccccaaggggatgctgcagaagaaatgccttttccgggtgacccgcaatgcggacatcgacgtgaaggagggcatgttcgaccaggacatcgactatcgtcaggtgatgagcgaactgctgaaaaagcggcgcaagctggccgccgtgcggctgcagttctggaacgagccgccccaggaagtggccaaatacctgtgcgaaaagctgatgctgccggaaaagcagtgcttctatcaggaaagcccgctggacctctcctgctacttcaagctggcggctcgtctgcaggcggacggacgcacagacctgttctacccggtggcaaagcccatgcaggcgcccgcgaacttcaagctgggcgaggaggcaaagcaccgggacgtgctcatcgcttacccttatcagagcatgcgccccttcatcaaaatgctgatggccgcggcctacgacccggacgtggtcagcatcaagatgaccctttaccgcatggccaacaactctcagatcgtgcaggcgctggtggctgctgccgaaaacggcaaggaagtggtcaccatcgtggagctgcgggcccggtttgacgagcagaacaacatcgactggtccaaaaagctggaggaagcgggctgcaccgttatttatggcctggatgactacaaggtccactccaaactgaccctcatcacccggcgcagcaagggccgctacttctacaccacccagatcggcaccggcaactacaacgaaaagaccagcgagcagtacaccgacctctccttcgtcaccacgaatcaggaggtgggcgaagaggcagccgccgtcttcaacaatctggcggtggagcgcctcaccgacgacaccgagcacctcatcgttgcgccgctgcatttcaagagcgtgctgctgaaagaaatggacaccgagatcgaaaaggcgcgtctgggccagcctgcccgcattatcctgaaaaacaactccatcagcgacaagaacatcatcgaaaagctggtggaggcatcccaggccggggtgcccaccgacatgatcgtgcgcggcatctgctgcgtgcag

SEQ ID NO: 1841 - DNA, 1719 bp, Faecalibacterium sp.
atggacgaactgatcggcaaaaaactggaaggccgctacctgctggaaagcctggtgggcgtgggcggcatggccaacgtctacaaaggacgtgacctcaagaccgacgccgttgtggcggtgaagatcttgcgggaggagttcagccagaacaccgaactggtgcggcgcttcaagaacgaatccaaggccatctccattctggaccatcccaacatcgtcaaggtctacgacgtctcggtcaccgaccggctccagttcatcgtgatggagtacatcgacggcatcaccctgaaggaatacatgaaccgccggggcggccccctcacctggaaagaggtggtccacttctgccagcaggtgctggacgcgctggaccatgcccaccagaagggcgtcgtccaccgggacatcaagccccagaacatcatgcttctggcggacggccgggtcaagatcatggacttcggcatcgcccgcttctcccgcgcggagtatcaggacaccagcgaaaaggccatcggctcggtgcactacatcagtcccgagcaggccaagggcgacgtcaccgacgccaaggcggacatctactccatgggcgtgatgatgtacgagatgctctccggcaagctgcccttcgagtcggacagcgccgtgtccgttgccatcaagcagattgccgacaccgccgcgcccttgagcgaggtggcgccggatgtgcccaaagcattgcaggacatcaccgcccgggccatggcgaaggacccggcgcggcgctatcccagcgcgcgggccatgctcaacgacctggaggagttcaaaaagaaccccagcatccggttcgagtacgaatatatgaccgaagattcgccagaaaggtatatcgacaaggtggttaaacagtcaagcggcggcccctcgggccgcaagggcccctcttcccagggcagccgcaaggcgccggccccttcttccggcagcaaaaacacccagcaccagcgcaaaccccgccgcaaggtgggcgttctgcccatcctggcgggcatggccgcggccttcgccctgggcagcgccattctgtgctatctcatctttgccaactccaccaaccccctgttcagcaacaaggcggacgtggaactgcccgatttcaccggcatgcagtgggagacggtgaaggagcagtactccggccagctgaccctggtggccgagcaggagtacaacgcccagtatgaagagggcgtcatctactaccagtcgccccgtgggccccgcaccgtcaaggagggccagaaggtcaccgtcaaggtgagccttggcaccctgtatgtgaacgtgcccgacgtgacccagtggaagatcgccgacgccgaagaggagctgaaggacttagggctgcaggtgcgccgcatgatcgtggaggacgactccctcgccgagggcaccgtcatccgcaccgagccggcggcgggcgagagcatcgccagcggcgagaccatctcggtctacgtcagccagaagaagatcgagaccgagaccaccgttcccccggtgaagggcatctccctggaggacgcccagaaggccctgaccaacaacaatctggtcaccggcgtcgtcaccgaggcttacagcaacgagtacgcggcgggcgtggtcattgattccacccccaccgaaggctccaccgtcaaaatttactcccaggtgggtctg

SEQ ID NO: 1842 - DNA, 1266 bp, Faecalibacterium sp.
ggcagccccatctgcatcgccaccgtgctgcgcaccaccctggcctacaacaacctggaggcggtggaggacggctacggcatcaacacccgccccctggccctcttcgccgagaacacctaccgggactgcgacatccaccatttctaccccaaggtggacgagagccgcgggccttaccaccgcagcgagctggcccgcgtggcccggatgcacaaggccatcgccgtcatcatgttcaagctggagtgcgccgtcatcgaccgcaacccagactttgagctggaagggcgggactttctgcgccgcatcgattttgcggcgggcaccgtggaggtggagggcaagcgctatcccttgcaggacgacgacctgcccaccgtggacccggcagaccccgcccgcctcacccccgccgaggaggaggtgctggcctcgctgcagcgctctttcaccgacagcgagcgcctgcagcgccatgtgcgcttcctctacgccaagggcggcgtgtaccacatcgaaaacggcaacctgatgttccacggggccatccccctcaccgagtccggcagcttccaggtggagaccttcgagcagcacggctatgccgggcgggccctgatggactactgcgacgagagggcccggcgggcctatttctcccccgagggcagcgaggcctggcagaccgggtgcgattttctgtggtatctgtggtgcggcaagctctcgcccctctatggccgggccaagatgaccaccttcgagcggctcttcgtggcggacaagaccacccacgccgagcccagcaacccctactaccgcttcgtcaacgacacccgcatggaccgggccatcctggcggagttcggtctggaccagacccgcagccacatcgtcaacggccatgtgccggtgcgggcggtggaaggggagaccccggtgaaggggtccgggcggatgatccgcatcgacggcggcttctgccgcgcttatcaccagcgcaccggcatcgccggctacactctggtctataacagccacggcctttccctgcgggcccaccagccctttgaaacggtggagaaggccatcaaagagaacctggacatcgtctccagcgtggacacgttcgagactaccaaaacacgggtgctggtgggcgacaccgacaacggccgcaagctggccgccgacgtggaggacctcaagcgccttgtggccgcctaccagaccggcctcgtgaaagagcgccccgagggctga

SEQ ID NO: 1843 - DNA, 1449 bp, Faecalibacterium sp.
ttgaattttcgagcgatcaaccataccatcgggtccatcatccttctggagatggccttcatgctgcccagccttgtgtggtgctgggtggaccgggacgggcactccgccctcgccttcggcgcgtcgctgctcatcatgggcgtgtgcgccgggctgtttctgctggtgggccgccgggcccgaggcagcatcttcgcccccgagggctttgtgacggtggccatgtgctggatcgtgctgtcgctgctgggctgcctgcccttttacatcagcggccagatccccagctacatcgacgctttgttcgaggtggtgagcggcttcaccaccaccggcgcctccatcctggcggaccctgccgagatgagccggggccttctgttctggcgcagcgccacccactggctgggcggcatgggcatcctggtgttcatgctggccatcctgcccgcgcggcagggcggcgcgctgcacctgatgcaggcggagagcccggggcccacggtgagcaagctcaccccccggctgcgccagaccagcaagatcctctacgccatctatctggcgctcaccctggcctgcatcctgtttttgctggcggggggcatgtccctgttcgacagcctgtgcaccgccttcggcaccgccggcaccggcggctttggcatcaaggcggacagcatggcaagctacagcccctatctgcaatgggtggtcaccgtgttcatggccctgttcggggtgaatttctcggtgtattacctgctgcttctgcgcaaggtgggccttgcggtgaaagacgaggacgtgcggctttatttcctcatcctgctggtcgccggcgcgctcatcgcctgggacatccgggacctcatccccgatctttccgagcgcatccgccacgcctatttccaggtgagcagcatcatgaccaccaccggcttttccacggtggattttgacgtctggcccgccttttccaaggccatcctgctctgcctgatggcggtgggcgcctgcgccgggtccaccggcggcggcctgaaggtgattcgccttttgcttatggtcaaaagcctgcgccgcgccatgcgccggaccctgcgccccagcagcgtgcagctggtgcgggtgaacggcaaggtggtggaggacgatgtgctccacaacgtgagcgcctatctggtggcctatgtgctcatcctcttcggcagcttcgtgatcgtctcgctggacgagctcagcctggagagcaacatctccgccgtgttctcctgcttcaacaacatcggccccggcttcgacgcggtgggccccatggtgaactacgactgctacagcgacctgtccaagctggtgctgacgctggacatgctgctgggccgcctggaaattttccccctgctggcgctgttcagccgccacagctggagccgccggctgtga

SEQ ID NO: 1844 - DNA, 1344 bp, Faecalibacterium sp.
atgcgcaaacaggacctgtttcgcctgtgcctgcaaaacctcctgcgcaagcgctcccgcacctttctcacggtgctgggggtggtcatcggcggatgctccatcgtcatcatggtgtcgctgggcatcggcatgaaggaggcccaggacaagcttctggcagagctgggcgatctgaccatcatcaccgtcaccgcgccccagggcgggcgcggcaaggtgaagctggacgacgccatggtggcccggctgaaaaaactggacggcgcggtggcggtgatgccccggcagaccatcgatctgccggacctgcacctttacgccggcagcgcaaggcgctatgtggcggactgggtgacggtgaccgggctggacaccgctggcatggaggccatgggcttcaagttggaaaagggcgagcggcccctgaagcccggcgaggtggtgctgggccagtacgcggcctacaacttccgggacaccctgcgccccgagggctccaacatggtggaccgctggtccgccgggtggaacgaggacaccggcaagctgaacgacccgcccccggcctattttgacccgctgaaggagccgctggtgctggaggcggagaacggcgaatacaagaccagcctcaccctcaagccggtggcccttgccaaggaggactactccaagggcatggagaccggcgagggggtgctgatggacctgaaggacctgaaagtcctcaccgaaaagctgcatctggtcaaaaagggcgcgtcgccctaccagtcggtgctggtgaaagcgaacagcatctcccaggtggcggcgctggaaaagcgcatccgcgccctgggctgcgccaccgaatccatggagagcatccgcgagcccatggaaaaagaggcccggcaaaagcagatgatgctgggcggcctcggggccatcagcctggtggtggcggccatcggcatcaccaacaccatggtcatgtccatctccgagcgcaccaaggagatcggcgtgatgaaagccctgggctgctatgtgcgggacatccgcgccctcttcctcgccgaggcgggctgcatcggcctgatgggcggcatcgtgagctgcgtcatcagctttgtggccgccttcatcgccaacatcgtcaccttgggcgggccgaccgccgaaaacctgcgcatcgcccttctgggcggcgacggccccgcccgggtctgcgtgacgcccccgtggcttttactcttcgccatcgccttctcggtgctcatcggcctgggctccggctactaccccgccaacaaggcggtgcgcatcccggccctggaagccatcaagagcgactga

SEQ ID NO: 1845 - DNA, 1641 bp, Faecalibacterium sp.
atgctgcttctggtgttctgcgtggcggccctggcgggcatcgccctgctgcgcatgcgtcaggacgcggtcacccttctgggcgcgcgtctggcggacgccgaacagctggcctccatcaccgccctgccccagacttccgccgagggctgtgtgctccactggaacggcgaggtgctgccctacgattctgcccggggcgtctattgcctgcctcagccgctggacggcagcgccaccggcagcctttccaccacctggggccgggtctacctgcccgcggaccagtgggcccagggccgccaggacgccatggccgaaggccggacgctggaagtgtatgtgagcgacggcaagcgctggtgccggctggaggtgtatctctccggcgtgcccgccctggtggtgcacacccagcgcagcgtgccctacaagctggacccccagtacgtcagcggcaccatggccagcctggacctggccttcaactacggcgaatacaccctgttctggccggagggcaactcccgaagccagactgtcacgggcaacatcgaataccactggcggggcaacaccaacctgctggccaacaaaaagtcttaccgcctgaacctgctggacgccaaaggccagccggacgcgaaggacctgctgggcctgggggaggacgccgactggttccttttgaacttcgccaccgacaccacccgcgcccgggacaaggtggcctggcagctgtggcagcagatggtgcagcagaacgaacacgacctgccgggcatccaggtggagtacgtggaactgtatctggacgatacatacgtggggctctacggcatcgcccgccccatcagccgggacagtttgcagctctcggccaatgacctgctctataaatggcgcaccatgcccatggaccgctccatgcccaccgccgagacctttgcgtccctggaagcggacgagagcctctcctggggcgtgtggctggaggtggtctggcccaagactttcagcgagggcgtgtggcagcccatggcggactatgtggacctctactacacgccgggcgcgcagaccagctggcagcagctggaaagcaccaccaacctggacaatctgctggatgtatcgctgttccggcagttcgtctgcgcggcggacaatttctcttataaccagtactttttgcaaaacagcgccgacggcctttactaccgcatcccctgggatatggactataccttcggtgatgtttatgatgaattctactctctggatatgacctccaccttcctgccggacatggagctggacaccctctattatgccgacagcggccgggcacagcagctcatcgcccagcgctggagcgaactgcgcggcacggtgctcaccatggagaacgtgaccgccctgttcggggccgcccaggagcagttgacggccagcggggccctggggagggacacggccctctggggcaatgcggagacctacccctgggagtctcatttccgcacgctggacgcagagcagactttggaattcatggagcagcgtctggcatttctggacgattacatggcggagtacacccccgccgaccgggaggcgttcgatgtattaccgaaatga

SEQ ID NO: 1846 - DNA, 2064 bp, Faecalibacterium sp.
ccccaccccggccacggcgagaaaaagcgcacggccctggcggaggacacgcccctggtgttcgcgctggcgggcaaccagaactgcggcaagaccaccttgttcaaccagctcaccggctccaaccagcatgtgggcaacttccccggcgtgacggtggaccgcaaggacggccagatccgcaagcatccccaggccacggtggtggacctgccgggcatctattccctctcgccctacaccagcgaggagatcgtgacccgggattttctggtgaacaacaagccggacggcatcatcaacatcgtggacgccaccaacatcgagcgcaacctctacctgaccttgcagctcatcgagctgggcatccccatggtgctggcgctgaacatgatggacgagatgcgggccaacggcaacacggtgcatgtgaaccacctggagcaggccctgggcatcccggtcatccccatctcggcggccaaaaacgagggcatcgacgagctcatcgagcacgccatgcaggtggcgctgaaccgtgaaaagccccagcggctggacttctgctccggcgcggtgcaccggtgcatccacgccatctgccacctcatcgaggaccacgcccagcgggcgggggtgccggtgcggtttgccgccaccaagctggtggagggcgacgcgcccatgctggagaagatggacctctcggacaacgagaaggacatgatggagcacgccatcaccgagatggagggcgaagtgggcaccgaccgtgaggcggcgctggcggacatgcgctacggcttcatcgggcaggtgtgcgccgagtcggtggtgcgccggggcgagagccgcgagcacgcccgcagcgtgaagatcgacagcatcctcacccaccgggtgctggccatccccatcttcctggccatcatgggggtggtgttctggctcaccttcggcctcatcggccaggggctgagcgacctgctcagcctggggctggaccagctcaccgccctggcggacaagggcctcaccgcctacggcatcaacccggtggtgcacagcctcgtcatcgacggcatctttgccggcgtgggcagcgtgctcaccttcctgcccatcatcgtgaccctgttcttcttcctgtccattctggaggactcgggctacatggcccgggtggccttcgtgatggataagcttttgcgcaagatcggcctttccggccgcagcttcgtgcccatgctcatcggcttcgggtgcagcgtgcccgccattatggccacccgcaccctgtccagcgagcgggaccggcggatgaccattctgctgacccccttcatgagctgctccgccaagctgcccatctacgccatgttcaccgccgccttcttcaccgaccacaaggcgctggtgatgatcggcctgtatgtgatgggcatggtcatcggcgtgctttacggcctcatcctgaaggcggtggccttcaaaggcgagccggtgccctttgtgatggagctgcccaactaccgtctgcccagcgcgggcagcgttctgcgcctgatgtgggagaaggccaaggacttcctggtgcgggccttcaccgtcatctttgtggccagcctgctcatctggttcttgcagaccttcgacagccggctcaacgtggtcaccgactccgccaacagcctgctggcggccctgggcggcctgctggctcccctcttcgcccccctgggcttcggggactggcgggtgtccaccgcgctcatcaccggcttttccgccaaagaggcggtggtcagcaccctggcggtgctcaccggctccagcctgaccaccctgccccaggcgctggccggcatgttcacccccctcaccgccttcgtattcctcaccttcaccctgctctacaccccctgcgtggcggccatcgccgccgtgaagcgggagatgggcagcgcaaaggccgcggcgggcgtggcgctgacccagtgtgccatcgcctggggcgtggccttcgtggtgcggtgcatcggcctggctttgggcctgggctga

SEQ ID NO: 1847 - DNA, 537 bp, Faecalibacterium sp.
atggcactggggtgcctcgcagttctgaccgcctgctccagcgacaaaagcacttcgcagacacaaagcaccggcacatcttcctctcaggcttcgtctggcagctctgagagcacagaggcgcaggagaccgtgatgggcgaggtgacctacgtcggctccagctacatcagcgtcactgcctacaccggcggcgaggacgtcaccgacttcaccactctggacgtttccgggctgacggcctctgaggacaccgagagcatcgacaccaccgaggataccgagtatctgaaagtggagtccggcatgctgaacgcagccacccgcgatgatgtgaccaccgggtccttcatcgtctccacctacgacgaggacggcacccaccagatcatcctggtcgagagcggcgacgcgacgggcaccgacactgattcggcctccgccagcacctctgaggacgaggcggccgaaggggcagactctgcttctgctgacgattcgacggtgagcgacgagagcagcacggccgaagcgtaa

SEQ ID NO: 1848 - DNA, 978 bp, Faecalibacterium sp.
catacctgcgtggaacttctggcggccggctatgacatcgtcgtggccgacaactactacaactcctgcccggaggcggtgcgccgggtgaaggagatctccggcaaggatttccgctttgtggaggtcgacctcaccgacgcggaaaaggtggagcagctgttcgcgcagaacccggacattgactcggtgatccagttcgccgcctacaaggcggtgggcgagagcgtgggcaagcccatcgagtactacaccaacaacctcaccaccaccctcaccgtgctggccgccatgcgccgccacggcgtgaacaatctggtgttctcctcctccgccaccgtctacggcgacccggagaaggtgcccatcgatgagaactgccgcgtgggcggcaccaccaacccctacggcaccagcaagctgatgaacgagatgatgctcaccgactgctgcaaggcctaccccgagatgaacgtggcgctgctgcgctacttcaatcccatcggcgcccacaagagcggcctgatcggcgaggaccccaacggcatccccaacaacctggtgccctacatcgccaaggtggccgtgggcgcgctggaaaaggtgcatgtgttcggcaacgactatcccaccccggacggcaccggcgtgcgcgactacatccatgtggtggacctggccaagggccacgtggccgccatcaagaagctggagcagaagcccggcctgttcatctgcaacctgggcaccggcaagggctacagcgtgctggacgtcatcaaggcctatgagaaggcctgcggcaagaccctgccttatgtcatcgacccccgccgccccggcgacatcgccactgtctacgccgaccccgccaaggccaagaacgagctgggctggcaggcgcagtacggcatcgaggagatgtgcgcggacagctggaagtggcagagcatgaaccccaacggctataagggctga

SEQ ID NO: 1849 - DNA, 1491 bp, Faecalibacterium sp.
atggaagaaaaacgtctgcaagaacggcttcgccgcgcagtggtgctcatcgtggccgcaggactgctgctgcttgccgccggggaaggggtggcggcgtttttggcccgttccatggtcgaggtcaccaaagaccagatgcgcgcagagaccgatgaatacaaaaaccggctggaaaagcagatgagttcggactatcagatcctgaccaccatgtccggctttctcgagttcagcaatgtggacgaggccgaaaactttgacgagatcctgaacgaggcaaacctgcggaacgatttcgtgtccatggcctatttcccgctgaacgggtctggcgttgtggccgttttgggtcagccggtgcgcagcgatgtggaactggcggagatgcagccggaggtgcaggaagtcgtggcccaggcctggcagggagagatggcgctgtccgacctggtccaaagcgaactgacgcaggagaaaattttcatttacgccatcccggtgagccggaacggcgatacagtgggcgcattgatcgccagcgatcaggtggagatattctcggacatcctgagcggcgacaccgtgctttccggcaacggccacaaccatctgctcaactccaagggcgaactgctgatccattcccagaattccgttgtggaagaatcggtggcttccatctatgaagaaccctatttcagcggtcagaaagcggaagaaattcggacagccctggccgccggggaaagcgtctattcctccttccgctgcgagggccgcagctatcaggcgctgttggagccggtggacatcaaggattggtatatgctctgtgtcagccgggtgcaggaagcaagcgggctttatcggatcgtgacggtcattgcggtcacctttgcggtgctgctgctgttgatggtcatattgcttgtgtacggctatcgcctgacccgccgcaacgaccgggaacttcgcgatctggctttccacgacgccctcaccggcggcgacaatctgcgcggcttcactttgaagctgcaagaggccctgagccagcggcaggatgtgaatttggcggcgctggatgtccgtcagttcaagttcatcaacgagatctttggccgcgagcgggccgacaagcttctccgccacatccatcagcagctgcaggcacggctggaggagggagaattctgctgccgtgacagcgccgacctgttctatgccgtgttgctgaacaccgacccggagcaggctgccgcccggctgcggaacatcatggacgaggcttgtgccgctgccctgcaggacgcgaacagtgactaccatgtcctgctttatgccggaatggtggcggcgccgcagtgcgccgcgtccgggaaggtggacgatgtgctcacccatgcgatgttcgcgctggagcgggccaagggcgccagctgcaacacggtgtggacctacgacacagaactgcataaaaaagaagaa

SEQ ID NO: 1850 - DNA, 2424 bp, Faecalibacterium sp.
atgaaacacaaggaactcatcgaacagatgactctggaagaaaagtgcggccttctgtccggccgggacatctggagcacccggtcggtggagcggctgggcgtgcccaccatctacctgtccgacggccccaccggcatgcgcaagcaggtgggcgagggcgaccatctgggcctgaacgccagtctgcccgccacctgctggcccaccgccgtcaccgtggcctgcacctgggaccccgctctgggcgaggaactgggcgcggccctgggcgaggaggcggtggcgcagggggtgagcgtggtgctgggccccgggctcaacatccagcgcagccctctgtgcgggcgcaacttcgagtacttctctgaggaccccatcctggcgggcaaactggccgcgggctacatccggggcatccagagccggggcatcgccgcctgccccaagcacttcgccgccaacagccaggagaccctgcgcatggccagcgacagtgtggtggacgagcgcaccttccgtgaggtgtatctcaccaactacgagatcgccgtcaaggaaggcaagcccaaattcatcatgtcctcctacaacaagatcaacggcacctacgccaacgaggacaagaccctgctcagcgacatcctgcgggacgagtggggctttgagggcgctgtggtcaccgactggggcggctccaacgaccatgtggagggcgtgcgtgcgggcagccatctggagatgcccggcaccgccggcgactctgaccgccagctggccgccgccgtgaaggcgggcgtcatcagcgaggaagtggtggaccagcgggtggacgaactgctggacgtcatcctggcggtggccccgaaggaaaaggccgacggcagcttcgacaaggaaggccaccacgctctggccgccagggtggcggaagaggccgtggtgctgctgaagaacgaggagaacatcctgcctctggccgccggcgcgaaggtggccgtcattggcgactttgccgccaacccccgctaccagggcgcgggcagcagtctggtgaaccccaccaagctggagtgtaccctggacgtgctggacaagatgcccctggagagcgtgggctacgcccagggcttcacccgggcggacgcggtggacaaagccctcaccgagcaggcggtggccctggcaaagcaggcggacaccgtgctgctctacatgggcctgccggaaatcagcgagaccgagggcctggaccgggagcacatgcgcctgccggacaatcaggtccagctgctgaaagcggtggccgcggccaaccccaacgtggtggtggtcctggccgccggcagcccggtggagaccccctggctggagcactgcaaggccctggtctacaccggcctgtgcgggcaggcgggcgcttccgccgccctgcgggtcatcaccgggcaggtgtgcccgggcggccgtctgagtcagacctggcctctggagtgggccgacgagccggtgagccattactggcccggacgccagcgcaccgccgaataccgtgaaggccccttcgtgggctaccgttactttgaaacggcgaacaagcccgtgcgctttgccttcggctatggcctgtcctacaccacctttgcttacagcgaccttgcggtgagcgagaccgaggtcagcttcaccctcaccaacaccggcagtgtggagggcgccgaggtggcgcaggtgtatgtcggcaagcccggcagcgccattctgcggccggccaaggaactgaaagggtttgccaaggtgcgcctggcggaaggggagagccgccgggtcaccatccccctggacgacaaggccttccgctggtacgatgtgcaggccaaggcctggaaggtggagggcggcgagaacaccgtgatggtgggctccagctgcgccgacatccgcctgtccggcagcgtgaacgtggcgggcgaggccgtgcaggccaccgcggacaaggaagcgctggcctgctattacgacctcaaactggacgatgtgcccgacgaggccttcgctgccctgctgggccgcgaagtgcccgaaggcaagtgggacgagaccaagctgctggagatgaacgacgccatctgccagatgtactacgccaagaaccccatcgcccggctggcgggccgcatcctgactaacatgaaggaaaaaagcatcgccaacggcaagcccgacctgaacatcctgttcatctacaacatgcccttccgcggcatcgccaagatgatgaacggcatggtgagcatggagatggccgagggcatcctggtgatggtcaacggtcacttcttcaagggcctggggcaggtatggcgcggctggcgaagcctttcccgcatcgccaaggccgagaaaaacgccgcgcagggctga

SEQ ID NO: 1851 - DNA, 1170 bp, Prevotella sp.
atgattattgaggagaaaataactttcgacaggttcatacgttggatgttgacagccgtcgttgtgatagcggtgctgttgcttatgaattatcttagcagcgtgctccttccgtttttcgtcgcctggctgctggcttatcttatctatcctgtcgtcaagttcgtgcagtacaggatgcacgtgccaacgaggattctgtcaatagcggttacgctgttgttcatggtcgccgtaatcgtgggaatcttttatctcataattcccccgatgatagaccagtttgacaaacttagcgacgtcttgacccgatacctccatgagaagacccacatagccaacttccccgcaaccatacagcagtggattaacgagaacaagaacagcatacatgagtttttccagcaggacgacgttaccgaagccataaggaacgccatgccgaaagtgttctctatgatagggcagactgcaagcatactgcttagcgtagctgcgtctctgataacattgctgtatctgttcttcatcctgctcgactatgagaaattggcgtcaggcttcataaagatgtttccgaagaaaagccgtccgttctggcatgcattgatgaacgatgtcgaacatgaaatgaacagctatataaggggacaaagccttgtagcgctttgcataggcatactcttctgtataggttttacaatcatcgacttccccatggccatagctctcggcatacttataggtattttgagccttatcccttacgttcatggcttggcattcattcctatgttgatcctgtcgttgctgaaagcagccgacacagggcaaaacttctgggtcatatttgcatctgccacggcagtgtttgtcatcgttcagataataacagacatggtcctgacgcctaaaataatgggcaaggcaatggggctgaatcctgccgtaatacttctttcattgtctgtatggggcgccttgctcggatttttgggattgattattgccctgccgctttcgacgctcatcatcgcttactatcagcgctacataacaaaagagaatgaagatgatttgtctgccgcagtcgacgatgactgttctgatcaggttgaaacagtgcctgatatgcctgttgataataaaaaaaaaccactgtcaagatag

SEQ ID NO: 1852 - DNA, 1107 bp, Prevotella sp.
atgaaaatcggtattccaaaagagattaagaacaatgagaatcgtgtaggaatgacgccagctggtgtatctgaattaataaaacacggacatagtgtctatgtacaaaagaccgcaggcgagggtagtggttttactgatgatatgtatttaagtgttggagcccaaatactgccaagcatagaagacgtttatgctactgccgacatgataatcaaagtgaaagaacctatatctcccgaatatccacttatccgtaaagggcagctggtgtttacatatttccattttgcatgcagtcgtgagctgaccgaagcaatggtaaaaagcggaggcgtatgccttgcatacgaaacggtacagctggctgacggatcgttaccattgcttgttcctatgagcgaaattgccggacgaatggcaacaattaatggtacatattatttgcaaaagaccaaaggaggcaaaggtaaattgatatgtggtgtgcctggcgtaatgccgacaaaggtcgtagtaatcggtggtggtattgtaggtcaggcggcagcccgtatggctgctggaatgggagctgatgtcgtaattgccgacatatcgttaccgctgcttcacgaactatcaataaatatgccggctaatgtaaacaccttgtattcatcagcacaaaatatagggaaggaaattaaggacgcagatattatcataggtgccgtgctcgttcccggagacaaggctcccaaacttattactcgcgagatgcttaagatgatggaaccgggaactgttctggttgacgtcgcaatagaccaaggcggatgttttgagacttcgcatccgacaacacacagcgaacctacttacgaagtcgatggaatcgttcattacgctgtcgcaaacataccaggcgcagtccccaacacctcgacaacagccttgaccaacgccacattaaaatatgccatagctttggcagacaaaggttggcgtgaagcatgccgcgagaatcaggcattatataaaggactgaacatcgtcgaaggaaaaataacctataaagctgtagccgatgtattcaatatgccatatgagcctataagtatttga

SEQ ID NO: 1853 - DNA, 1035 bp, Prevotella sp.
atgccagttggcacgtgcggcagcgtaaagggcgtgcatttcagcgaactgcgcgaacaggtgaaggcacaaatcatattgggcaacacttaccacctctacctgcgcccgggcctcgacgtactaaaggctgccggaggcctgcataagttcaacacatgggacaggccgatactgactgacagcggcggcttccaggtattctcgcttacgggtataaggaagctcaaggaagaaggctgcgagttccgttcacacatagacgggtcaaaacatttcttcacgcctgaaaacgtgatggatactgaaagagccatcggtgcagacatcatcatggcctttgacgagtgccctccaggacagagcgattaccaatacgcaaagaaaagcctcacactgacacagcattggcttgacaggtgcataaagcgtttcaacgagaccgaaccgctttacggctaccggcagacgttgttccccatcgtgcagggatgcacgttcaaggaactgagacgtgaagccgcaaaatatgtggcagacaagggtgcggacggtaatgcaataggcggacttgccgtaggcgaaccgaccgaggttatgtatgaaatgatagaggtagtcaacgaaatcctgcctaaggacaagccccgatacctgatgggagttggtactccgcagaacatacttgaagccatcgaacgcggagttgacatgttcgactgcgttatgccgacaagaaacggcaggaacgccatgctcttcacatacaacggtacgatgaacatgcgcaacaagaagtgggaaaaagacttctcgcccatcgaccctgacgggtgcgacgtggacaagacgtactcaaaagcatacctgcaccacctgttcaaggcacaggaactgctggccatgcagattgcaagcatacacaacctggctttttaccttcgccttgtgagcgatgcccgtagccacattgaagccggtgatttcgtaaaatggaaatcttccgtaatagaccaactgggaaaacggatttaa

SEQ ID NO: 1854 - DNA, 1020 bp, Prevotella sp.
ttgcaggctcaagtttttgtcgaatcgaaaatagattcgattgaaattttgatcggtgagcagacaaatgtaactctaagcgttacggcgaagaagggcgccaacgtcaaaatgccagaatacgagccgtcgcaatatattacgccgggggtggaagtcctgcaaaatacagatgctgacacttccaaactggataacggacttgttaagattacaaaaagatacacgttgacatcgttcgatgaaaacctttattatcttccaccaatgaaggttaaagtcgatggcaaggaatataaaagtaaaagcctggcattgaaagtgttgacagtacctgttgatacgttgcatcctgaaaaattctatccgcctaaaggtgtacagaacaaccccttcgagtggagcgaatgggaatctacattttggttgagcgttgtatgggtattaatgtgtgttttaacatattacctgtggacaagactgaaagagaataagcctgtgatagttaaaatacgcatggttaaaaagttgcctcctcaccaaaaggcattaaaggaaattgaacagatcaaggaaaataaaatgtcagtatctgaagaccaaaagacatattacactcttcttactgacgtaataaggaaatatataaaagcaaggtttggattcaatgccatggaaatgactagttcggaaatcattacacgcctgcaacaagaggcggataaaaacatgatagacgaactgaaagaactattcatgactgcagatttggttaaattcgcaaaatattccacactgataaacgagaatgatgcaaatctcgtcaacgccgttgagttcattaatacgacaaaactggaaaaccaaccaacaatcgagcgtgttgaaccagatctgacagaagccgataagatgaaaatgcgttcgcgcactatgttaaaaggtacggtaatcgcactgtcagtcatcggcgtcgtgctctttgcttatgttgtataccaggcgtatttgctgatatag

SEQ ID NO: 1855 - DNA, 897 bp, Prevotella sp.
atgtggaaaaatagcaatcgctggttttataagataatattttttgccgcgtcgctggccgtcgtttcgtgtggaacgaagaaggctgcggtggatgcaacatcgccgtcgggcggtattgtagtcaagcacggtgatgaagtgactgatgcgcaaagcttcgtccgtaaggttcatgccaaccaagtaggcgctggcgccatatcggcaaaaatcaagtttaccctcaaacaaggacagaaagacctgtctgtgtcaggctcgttgaagatgaagaagaacgaggtggtgcgcatacagcttacggctttcggtcttatggaggtgggacgccttgagttcacccgcgactatgtgcttgtaatggaccgtatgaacaagcagtacattaaagtaaaatatgccgatgtaggcttcctgcgcaacaacggacttgacttttacgccgtccaggcactgttctggaacaagcttttcattcctggacgacaagccgtggacgatgcttccctaaagctgttcactgtgaagggcaatacggcttcagcctataatatagtagccttgaaacacggtgaaatggactatttatggagcgcaggaaagacaaacggactgattacatcagtcgacatgacgtacaccggcaaggctgccggcaggacgtcggtgaaatgcagttacggttcgttcaagtctttcatggcaaagaaattcccgaccgacataaccctgacggttcagagtgccgacattaaaaaagccggcaacgtttctgtaaacatagcattggacaaacttgacaccgacagcgattgggaaacttatacctcggtttcgggcaaatacaaacaagtaagcgtggaagacgtaataaacagacttctgaaactgtaa

SEQ ID NO: 1856 - DNA, 888 bp, Prevotella sp.
atgaaagcatttgtttttcccggacagggagcgcaattcgtaggtatgggtaaagacctgtacgacaacaatcctttggcaaaggaacttttcgagaaagctaatgatattcttggttacaacataaccgagatcatgttcaacggtaccgatgaggagctgaagcagacaaaagttacccagccggcagttttcctgcatagtgttatcagcgcattgtgtatgggcgatgactttgctccgtcaatggttgctggtcactctttgggcgagttttcagcacttgtcgcagcaggcgcattgagttttgaggatggattgaagttggtttacgcccgtgccatggccatgcagaaagcatgtgaggcttctccttcgacgatggctgccatcattggtcttccagacgagaaagtggaagaaatttgtgcagaggtaaacaaggatggctatgtatgtgtacctgctaacttcaattgtccgggacagctggtaatcagtggtaacatcgatgcaataaatgaggcttgtgagaagcttaaggctgcaggagcaaagcgtgccctgcccttgaaagtaggtggagcattccattcgccattgatgcaacctgcaaaggacgagcttcaggctgctatcgagaagacagatttccatgctccaaagtgtcctgtatatcagaatgttgacggaatgccccatactgatccggcagaaataaaagccaatcttatagcacagctgaccagctcagttaagtggactaagtgtgtacagtcgatggttgccgatggagctgacgacttcacagagtgtggtcccggtaaggctcttcagggtatgatagcccgtattgacaagaatgtagccgcccatggcatagcataa

SEQ ID NO: 1857 - DNA, 870 bp, Prevotella sp.
atgaaacgtttatttattaccttattattaatactgacggcaggaatgattattcccgaatcagtattggcgcaacagcgctataagataggagtgtgtgactggatggtgcttaagcgccagaagttaggagaattcaagctggcaaaagaactcggctgcgacggtatagagatggacatgggaggcctgggcactcgccgctcgttcgacaacaagatgcgcgaccctgagtccgtacgcgtattcagccacatggccgacagtttcggcattgaaatcggagccgtggcaatgtctggtttctacggccagagtttcgccaagaaagagagctggcgctggcttatacaagattgcatcaacactatggagaaaatgggcgcacgcgtagccttccttccgctcggcggttgcggctacaactgggctgactcgctccccctccgccaggaaatcgtatggcggctgaaggaggccggcgatatggccaaggcacgcggcatggtcatcggaatagacaccccgctcgacgcagagggcaacatcaaactgcttgacgaaataagctccgacggaatcaagatattctacaagttccagacagccatagaatacaagcgcaacataccgaaggaaatcaaggcactcggcaaagaccgcatctgcgcaatccacgcaagcaacactgacggcgtatggctgcgcaacgacaaagcaataaacatgaaaaagataaagaaggcgctcgacgagacaggctggtcaggctggcttttcgttgaacgcagcagggacgtgaaccaagtgcgcaacgtcaaactcaactacggagaaaatgttaaatatctaaaagaaatactgcaatga

SEQ ID NO: 1858 - DNA, 630 bp, Prevotella sp.
atgaaaaagattatctgttcgctgctctttatggcagccatggtttcgtgcacgcagcaggcagaaaccccgacggcaacggccgacgacgccgaagtagtggaaaaagtgatgatgtcgaggcgcagcatacgccagtacaccgacaagcggataagccgcgacacgcttaaacgcatactcgagtgcggcataaacgcgcccaacgggcagaaccgccaggcttacgagatacgcgttgtcgacaacccggagctcctcgcggaaataaccgccgccgtggtgaatgacaacaaggataacgcacccaagaacggagccaaaaacatattcgcaaacgccacgtgcgtggtgttcatcgccaacgacaccacctacgacgtgtctcaggttgactgcggactgctcggcgagaacatcatcctcgcagcatgggcaaggggcatcggctcctgctgcatggcacaccccgtacgcctgatgaaggacagcaagtcgtgcgcaccgtacatagaaaaactcggcttcagcaaagactataacctgctgtactgcatcgccatgggctaccccaacgaagcgcctgacgcaaagccgcgcaaaaccgacaagatacgcttcatagactga

SEQ ID NO: 1859 - DNA, 510 bp, Prevotella sp.
atgatgaatatagtaaagatacatgatgcagacttgcgtgaggctgctgcgaaaggacttgacgattttgtagacgttttttataaagctgcgcttgacagtgtcggcggctctgtcgacggcgaatccatgctgaagctcaatcagtatcagatgacgcttgtcgtgttcaagaccttgcatgatgaagttatggacggagggttcgttcagcttatttacaacggttacgggccttttgtttttttcaatccatttgccaaggcaatcagggaatggggacttgacgatctcgcatctttggttaataaggctggcaaactgttccgtaaatacggtcgtgagattgaacgagaatgctcggatgaagagtttatggccttgtttgagaaatatcctgattttgacgatcttgacgaccaatttgttgagaacgaggaacattgggtggaagaaattgccagctatatagacgaacatattgaatgttttgcaacggtggtagattaa

SEQ ID NO: 1860 - DNA, 444 bp, Prevotella sp.
atggtaatagatacgattgaaaatcttgaaaaatatgtttcactaaatcctttgtttaaggatgtggttgagtttattaagtctaacagactggatgatttggaagttggtaagcatgctattaagggggcggacttgtttgttaatatacaaatggcgaaaggtaaatcaaaagatatagccttgttagagacacataagaagatgattgacatacaaataccacttagcgctcctgaaacgtatggttatacccctttgtgtgacttgccggaggctgagtataatgaggaaaaagatataacaaagtatgctggtgaggcgaatacatatgtaacatgtaaacctggtgagtttgcgatattctttcctcaggacggacatgccccatgtatatcaggtgaggcagagataaagaaggctatttttaaagtgttggcttga

SEQ ID NO: 1861 - DNA, 348 bp, Prevotella sp.
atggcacttaacacggaaaagaacctgaaactgtattactcgataaaggaagtggccgagatgctcggagtatcggaaagcatgctgcgtttctgggagaaggaaataccgtcgctcaagcctaaaaccacgggcaacaacgtgcgccagtacaccgaggctgacatagagaaggtgaaggtcgtgtacaacctagtcaaggtgcgcggcttcaaactggccgccgcacgcaagatgctgcgcgaaaacaagcagggagccgacgacaacgcacgcctgatagaaagcctaatcaaggtgcgcgacgagctgaaagagataaaaaagcaccttgactatctggaatag

SEQ ID NO: 1862 - DNA, 204 bp, Prevotella sp.
atggcaaagaaagagaatagcacaaagagcttcgtcctgcgcgtagacgccgacacgatggcggcaatagagaaatgggccgccgacgagttccgctctaccaacggacagctgcaatggataatagcggaggcgctgcgcaaaagcggacgcctgcccaaaaagcgccgcacggccggcgagggaaaggaggacgaggcatga

SEQ ID NO: 1863 - DNA, 1425 bp, Prevotella sp.
ttgaataacaaaaaatactccatcaatgaccaggctgtacgtgaacacatcagcagattgataaaagatgatggtgttctaatttctgcagaccgccaagtcatacgatactacgccgaaaacaagccattcatttggattaaccgacttggcatacacaatcgtgctgatactttattaaagataatacaaaaagctgatttatacggattcagcactcgcatgcttaaagtaagccaaattgagaaagacctgaatattatcagaagcttaaatgtgtctgatggaaatgataatattaatataatcctggcacgtttagaatataatctcacaaaagcccttctacgatattccaccggtttacgttatggtatggtaaatccagattatttgtataataatttggaaaaatacgaagtggattctacttctaccaaattccgccaactatcagacttaaggatagaacgtccaaacaacgaattctatttgaaagtgattacgcaagcaatgaatgacagtattgtagatctatttgcaacaatacttccccaaaacgacctttatgaaaaattaatacaacatctaaacagaaacggacttacctatgaagaaaaagtgaaaacgatctgcaatatagaaagatgccgttggagattgaagatattgtcaggacaaaacaagttcaataaatatgttgaggttaacataccctcattcctattacgggctattaacaataatgacattctgacaatgcgtgtcgggtgtggaacaacgcaatataagacccctcttttgacaagcaagattaccagaatggacataaatccccagtggattatacccaaaagcatttccaaaggttatgtcggaaatcaccaatacatgcataaaatgggaatgtttgtgtatgacaagaaactcggaaaactgccacctgaagaagcgtcgtataataaagtaatgaatggggaacaatatataatccaagccggcgggcctaagaattcattaggacgaataatattcagattcaataataatttctcagtcttcctgcatgacacatcgtcaccttggctattccaacgtaccaacagagcagtaagccatggatgcataagggtagaaaaaccatatgaactggcattattcttattaaatgaaagaaacgagaaactgcaagaaaagctggaatattcaatgacagtagaattggtaaatgataacgactcgctgagaaaaagcaagatagacaggagtcgcatgataaattctgtctcggtaaacccatcaataccattatttgtaacatattatactaaatattgggacgaaaatggccgactggctgattatcaagatatttatgggtatgatgaagtattgtacaacaagctgaaaccatttgttgagtga

SEQ ID NO: 1864 - DNA, 1314 bp, Prevotella sp.
atgtactataatgtgttaacggcatttacatggaaaagtgactcacaaacctcaaaacaactacgcatgaaaagaatattattccttttgctgactctccatttaacgatatcatacgcacaaaagaatgaaatttacgacaatggtattgagtcattgcaagttgttgccggctctaaatggatgtcacttcccgtaatacagttaggcagccacaccccaaatgacataataaatataagctttgacgaccttacacacacataccaccgctatgcatacaaaatagaacattgcgaagctgactggactgtttccgaccaacttttcacaagcgactatatcagtggtttccaagacggcaatacaatagaagactacgaagaatccattaatacaaacacactttatacacattacaagttggaaattcccaacagacaatgctcactgaaaatgagtgggaactataaagtaaccgtgtatgacgaaaacaacaacgaccgcccgatattcactgcttgcttcatggtagtagaaccactcatgggtgtacaattgaatgtaacaccaaatacagacattgacattaacaaagcacatcaacaagtggagatgcaagtcaactatggctcgatcaatgtcactgattactcaacacaaattaaaactgtaattatgcaaaaccggcgttgggacaatgcaagaagcaatacaaaaccacaatatattatgtcagatggccttaaatgggaacacaaccgcgaccttatatttcaagccggcaacgaataccataaatatgaaattttagatgtatcacatccaacaatgggaatcgaccgcattatttgggacggtaccaattaccaggtatcccctttcgcctgcgagccgcgccctaactatgtatatgacgaagacgcaaacggtgctttctatattaggaatagtgacaatatagaaaacgacatttcttctgaatatgttttcgtaaactacaaactattcgtaccagaacaagttaagggcgacatatatattaacggaacatggactaacgaccaatttatccccaaatataaaatggagtttgacgccttgaacaaatgctatacagccaaaataatgcagaaacaaggatattactcatatcagtttgtaatgctagacaacaatggagtaagctgtgtcgtaccttctgaaggcagtttttatcaaacagaaaataaatatcaagcattaatatacttccgtggtaacggcgaacgcactgacagacttgtcggataccaagaagtacaaattaaataa

SEQ ID NO: 1865 - DNA, 1167 bp, Prevotella sp.
atggaattatctataagtaattttggtcctataaaggaggcaaatattgatttcggcaacttgacattcttaataggtccgcaggctagtggtaagagcctgtctttggagttgctgaagttgataattgataagtcccatattgtttctacgctccggaattataattatattttgagtaaaacagatgccaagaacattttggactggtattttggcgaaggcttatcgggcttgtttagggcggataccaagatagctttagataataagcctttttctacacaagacttgcttaatgtaatagctggacaaaatgtttccggactgtgtaaggagtctgtattttatgttccggcacaaaggattttgagtatgtcggaaggccgtccaagaaattttatggaatatgacatttcaactccttatgtgttgaggcgttttagcgagacgttacgcgtattcatgcagggcggtttaggaaaccctgataccatttttccgataaaaaacagactggaaggggctgtgaagaaatctattaatgatacaatattccatgacggaaaggttgttcttgataaaaccggcgtgcagcggaacatgaaactggaggtggacggaatgagaatcccatttatggcgtggagcgcggggcagaaggagttcatgccgttgctgttggccatatactgcctgtcagggcctcctacacaagtggttgacaagaacgactatgattgggctatcatcgaggaacctgaaatggggcttcatccacgggcgatacagtcggtgttgttggagattatcgaactgatacagaatggcaagagggtggttgtttcaactcattcaacgacattccttgaatttgtatgggcgtttaataacttggtaggtttgccggacgaagaattcaagaacgccatgtgcgagatgtttgggatacgcaaggattcaaatgccgcggggctgtttgacagattgaaggagaggacgataaaaacgttttattctgctaaacatcaaactgaaggtggcgtaaccttctctgacatatctacattggatgcctttaatgaggatactgatatttcggaatggggcggattgtctactttttcgggaaggacatcagaaatagtcagtcgctatgcagagtaa

SEQ ID NO: 1866 - DNA, 1107 bp, Prevotella sp.
atgtcgcaagtaaggaagaatgtggtagtaaacaagtcgaacaaaggaaaagccgaattgcctggtaagtcggacgaattgtttgaaagtatgttgccgacaacggcccagatattagttattgacagttttatcgccactaagacggattttatagacaagattccgttggagaaggattttgggcagataagtacttacgatagattgaatcatactacaggccaacagtttgcatatacttatgtaaatgggttcggtaataggatgttttttgccaagaaaggtaaagacgggcattacaagatgttttcagcggacaggctggataatgaatggaccaacgtaaaacagatcaatgactttggtgatgattttgaggacataaattatccgtttatgcttgcagacggaacaacgctttatttcgcagcaaaaagtaaaggcggattaggagggtacgatatttatgttactagatacgacataagttcggaaaagttttataagccggagaatatgggtctaccttataattctaaggataatgacttttactgtattatcgatgaatttaatggtttgggatggttggtaacagaccgcaggcaagatggagataatgtatgtgtgtacgtatttgttcctcagaaagagcgtaaaatatacgattccgaggaggttgacgatgacgaattatataattatgctgaactgtatagtataaaagatacgtggacggataagacggaacttgaagccggacgtgagagacttagtaagctattggaaaagcgtgacaatgtgaagagaagttcaatatactttattgtaaatgatcatacgatttataagtctttgaaggattttaagtcacctgcaaacaggaaacgttttatgaaactcaatgagctgaatgagtctgccgatgagttgtctaaaaggcttgactctttcaggcaaagttattctaaaagctcacaggctgtaaggagaaaattgggggctgatatattgaaagcggagaaacagcttgaggaccttcgcgggtatataaaaacattagagaaggaaataagaaatacggagaatatgattgagcggtaa

SEQ ID NO: 1867 - DNA, 822 bp, Prevotella sp.
atgctgtacatactctccgactgtttgttttattttttatattacatcgcccgataccgccggaagattgtacggcaaaaccttacagaatcatttccggaaaaaagtttaacggaaataaagcatgtcgagaaagagttctaccatttcttcatggatatgattctcgaaagttgtaagctggcatcaatatcaccaaaagaaataatgaaaaggatgaaattcacgcatgttgaagacgtaaactcactgataagacaaggtgtatcagtatcaatatatctaggacactacggaaactgggaatgggtgtcatccatgccgctatggcttgagaatggagtaacaagtgcgcaaatataccataaactgcgcaacaaaaacatggaacgcctgatgatgcacatacgcgagcgcatgggagccgtatgcgtagacatgcacaaaacggcaagatacgccacgaaactggctgacgaaaaaaaagtatgcgttatcggattcatcgcggaccaatcaccaagaaaaagggaatcacgccatttcttgcatttccttaaccacatgacacccgtattgactggaaccgaaaaaattacaaagcattatgggtttgaagccttttacctcaatgtaaagagaataagaagaggatattatgaagctgatttttcaagactgcatgacaattctcgctcacttcccgattatgaattgacggcgctatatttccagcaattggaaaaaacaatccaaaggcagccggaattatacttatggacacacaaccgttttaaacatgcagaaaaaacaaatgcatga

SEQ ID NO: 1868 - DNA, 669 bp, Prevotella sp.
atgcagactaattattttgataaaatgacaggagcaaagatacgtgcggctctatttgacttagatggtgtcgtgtttgatacagagagccaatactctattttttggagggaacaatgtgaaaaataccatcctgacaaacctggacttgagaatgtaattaagggccagactcttgtggagatatttgaaaagtatttttctgaatttaaggacgaacaggctgagattgtttccaggttaaacgaatttgagcagaagatgagttttgagtatgttgcaggttttaatgattttattgtttctttgagacaaaaaggaattaagacagctgttgttacaagctcaaacttgatgaaaatgcattctgtttattcaactcatggtgagttcaaacaattatttgacgtaattcttacttctgaagattttgaaagaagcaagcctgatcctgattgttattttaaaggtgctgcggcgttaggggtggtgccttctgagtgtatggtttttgaagatagttttaatggtttgaaatctggcagggctgcaggtatgacagtggtgggtctgtcaaccactaatacggtcgatgcaatcagaccgttatgtgatattgtaattccagatttcaagcatgtgcctgttcaacttgaagatgtattgtaa

SEQ ID NO: 1869 - DNA, 552 bp, Prevotella sp.
atgaaaacagtttatgatttcactgtcaaagacaggaaaggaaaagacgtatcgctcaaagaatatgcgaacgaagttttactgatagtaaacaccgcaactaagtgcggattcactccacaatatgaggaactggagaaactctacgaaaggcatcgcagcgacgcatttacaatattggacttcccctgtaaccaattcggagcccaggcaccaggaacagacgagtcaatacatgaattttgcaaattaacatacggaacagagttcccccgtttcaagaaaattaaggtaaacggcgaagacgctgatccgttatataaattcctgacaagccagaaaggatttgccggctgggacgagagccatccgctgacacacattcttgacgaaatgctgtcaaaggaggaccctgactataagagcaagtcagacataaaatggaacttcaccaaattcctcgttgacaaaaagggaatggtagttgctcgctttgaacctaccgaaaaaattgaaaacatagaaaagcaaatcgttgaactccttaaataa

SEQ ID NO: 1870 - DNA, 498 bp, Prevotella sp.
atgtgtaatgcggcaaacccacgccttacattatgtcaggacaacgcgcataaaacggacaaaacgacatcaagactttgtcgggaaaatctgctgaaacagaaaaaggaacggccatctacgccccaatgcggcaggcattgcatgcaggtaaacggcaaaaggcatgcttatggcatgcaatacataagcttttgcagggcaaaaggtctgttttcgcagcgcaaaacgatggtttttaccgtctttttgaccatgtttcacggcctttcagcagtgattttaatgcacagtttacgggaatatgttgcaacgtattataaaacaaaccgttacgtttgcacgcatttttgcggttatttacggccggatgtattttatttcagaacgacgcagttgtggagcgtcatgcaaaaacaaactgtaagcagaaacggcattatggcgacaatgtgcatcgcaagccgtttttgcttacagctgtatcggtatcaataa

SEQ ID NO: 1871 - DNA, 393 bp, Prevotella sp.
atgaaaaagacaatgttaaccacgtcactgctgctagctgcccttttatcatctgtaacggcctcggcacagcaagaaattaagctcactgtcaacaatatcccaaacgacaagggaacaatcctcatagcaacaaaaagcggacaatgggcaaaagcaaaagcacagaaaggcaaaattgaaaccatcttgcacgatgtgcctgaaggaaaaggcacgatatacgcattccacgacgagaacgacaacaagaaactcgacgaaaaggacaacatcccagtagagtattgtgccttcagcgattacgaaataagcgctgggaataataatatcagcatcgagcttatatacgttccagacaagataatggacaaacaagaagaaaacaaatga

SEQ ID NO: 1872 - DNA, 369 bp, Prevotella sp.
atgaaacaatttgttttctctaaaaacctgaaaggtttttttagtatgttcctctttctgtcagtgtctttaatgttattctcggcttgttctgatgatgaaacttatacggggcggttaagtgtggtttttaatgaatggaaacctgaatggacagaccgtacggttattacagtaacacctatggataatgaagacaaaataataaagacggttaaggctgttcgtgatacgaaacatattatagaattaaatcctggaaattatactgttacctttaaaggatatggagacggatatggttatcctcggattgaaaagtatgtgcaagttcaaattggtaaaacggcagtcgtcgagatgaattag

SEQ ID NO: 1873 - DNA, 2397 bp, Prevotella sp.
ccaaacgaattaattatgaggaaaatatcaatactcttgttattaatgatgttgtcggttgtttctgcgcatgcggatgcaatctattcgacaacattcgacacggttgacgagtttaatacttggaccgttgttgatgcgaacagcgacggagcaacatggcttttcaacgaggaaggctctccgtcaaaggtggcctacaagtacgattacttcaatagtggcgacgattggcttatttctcctgccattacaccaactgagactggcacgctgattgtgaagtacacgtttgtgggcagtccttatggtgagagcatggaagtgttctccggtacaggcaatactgttgacgacatgacaaaaaaggaagccacatacgataacattgtgaaaaacgaacaggcgggctatttcctttatgacggaaaggctggcgaaccgttccattttgcgttccatgcaacttcgactgcgtataaggactatctttacatctgttcagttacagttgagcctattgcaaatccagttgacgtgaaggtctctgagattatcagtcctgtttcaggtatggggctcggacaggaagctgtaaaggttgccataaccaacaatggccgtgttgacctggcttcgtttgatgttgcgtttgccgtagacggtaaggaaatagctacggaaacagttaatgaaacgttggctgcaggtgcgacaatggaatacacattcaatgctaaggccgacctctcaactcctttggctacttacagcataaaggcttgggctactcatcctgacgatatcgaccatcctaacgatacctgctacacttctgtaaagcataaggcaccacttaacgtgccgtacacaatgggattcgaggcttcagagaacacggaagacttcaagttctacaaccttaacaacgacgaaggtacttgggacgtagtcatagaatctggattctataatatggcacgcactggaaacggttgcctttcttatggatacgactcaaacaatgacggtaacgactgggccatgcttgacccgataaatgttgagcccggctattatgtacttaaattctggtattccaacttacagtcatatcctgagaaactggctgtatactggggtaatgaagccactccggaggccatgaccaacaagattgttgagtatgctccgttctcggttgacgtttatagtgagtcagtcaatataatccattttgacaaggcacagacaatttaccttggattctacgcattcagcgagaagaaccagaacctgattctcatcgacgatgtctcgttcgacaagattgaatcggagacaggcgatttggctttgtctgatttgcagaatgttcccgacttcgtgcgtgagagcagtagcaaggatgtaaaattcaatattggcaatggcggtatcagcgaggtgaatgccaaaattaatgtcagcattgacgacgtagtggttaaggaaagcgaagccgtagcacgtccccaggttcttacggaaattacaattaacgatgtcctggtagacctgagtgacggcaaccatacgctgaaagtcgaggtagttaatgataatgaaggaattgctgacaacaatgtgctgacgaaagacttcacagtggtaagcaagccggctaaattctggaactttgaggacggccagttgccggcagagttcacattccgtgccgaggatggcggtacggttagtcctgcggcaggtgatgaattcaatgaagacggttggggacttttcaatattgttgaacatgaagtgtttggtgaatatctgttggccggtacatcatggttgaatggcacaagccaggccgacaggtggcttatcctgccacaggttagcattgacggacctgacagctatttcgtatgggatggttattcgtacaataagacgtatcttgaggattaccagattatggtatccgagagcgatgacaatacagcaagtttcactgaacttcttactgttgaagatgaaagcatcgaacccaagacacgcggaatcagtctggcagactatgcaggaaaggatatttatatagccataaggctgagaaccaagagtggagactgcctgttgcttgacaacatcggaatctatgtagataagactccgacatgcatttctaccgttactgactcaaatgccggtgttgtgatttctgctaacgaactgcgtgccgcagacggtgtgaagagcatagcactcagcgatgtgtcaggccgtgtattgcgtacagccaacgctaatgtgataagcctttccgccctgccttcaggagtttatgttgctactgtaaaggctgccgacggaagcaccaagagctataagttcgtaaggaagtaa

SEQ ID NO: 1874 - DNA, 2040 bp, Prevotella sp.
atgaaagtaaaacacattattcctatcgtattgttcgcttcggccccaatggtcgctagcgcacagacgcagttgaagtcaggcatagacttggcaaatctcgacaacagcgtcagaccggcagataacttctaccaatatgcttgtggcggttggatgaagaacaatcctcttccggctgcttattcacgtttcggaagttttgaccagcttggccagaacaacaacaagcgtgtaaacgacattctgaccgacttgttgaagaatacttatcctgccggttccacggagcagaagttgagcgacttctataagctggcgatggactccgtgcgtcgcaataaggaaggggtgaagcctgtaatgccgctcatcaatgagattgagagtgcaaaaacggttgctgacttgcattcaatccagctgaaatacgccttgttcaactacggcgtgcctatgggcataggttttggcgcagacgagaagaatgccaagatgaacatcctcaatatataccagggcggtcttgtacttggccaaaaggaatattaccttgacactgatccgtcaacaactgcaatccgtgatgcttataagaagcatattgtacgtatgttcaagctgttcggattctctgaggctcaggctcagaaaaagatggagaacatactgaaggtggaaactgcactcgccaaggtttcaaagtcgaggaccgagcttcgtgacgttgaggcaaattacaataagatgacgctcgaacagttcgagacggcttatcccaacgtaaatcttaccaaaatgctcaacgcccagggtgttaagacagaatatttcaaggaaatggttgtaggccagcctgatttcgttaagggtgccaatgacgtattggcaggcattacagccgacgaactccgtgcgtatatggagtgggacgtaataatttcttctgtcaactatcttagcgacgacgtgatagaggctaacttcgacttcttcggccgtacactcaccggacgcaaggagaaccatccgcgttggaagcgtgccactagccaggttgaaggccagatgggtgaagcgctcggcaagatgtatgtagagcgttatttccctgcttcgtcaaaggcccgtatggaggctctcgttaagaacttgcagatttcactggctgaacgcatcaaggctcaggactggatgagcgacgctacaaagcaggccgcactcgacaagcttaactctttctatgttaagattggatatcctgacaagtggaaggatatgtcaggcttgacaatcgacccgaaactttcttattacgagaatgtgcagaactgccgtaagttctgggccaagtgggatattgactaccgtgctggcaagcccgtagaccgtgacgagtggttcatgactccgcagacagtcaacgcatattacaatccgacaacaaacgagatttgtttccctgcaggtattctccaggctccgttctttgatccggaggctgacgatgcgttcaattatggtgctatcggagttgtgataggccatgagatgacccacggattcgacgatcagggccgtcattatgacaagaacggaaacatgacagactggtggactgagagcgatgccgaaggcttcaacaagcgtgccgatgtctgcgttaagttcttctctgcaataaaggttttgcctgacctgaatgcaaacggacagcttactttgggcgagaaccttgcagaccacggaggtcttgaagtttcgttcaacgcattcaagaatgctacaaagaacgctccattgaagactatcgacggacttacgcccgaacagcgtttcttcctggcatacgcaggcgtatgggctgcaaatatcacagatgaggagattcgcaaccttaccaagatggatcctcactcactcggaaagtggcgcgtaaacggagctttaccgcacattaacgcatggtatgatgccttcaatgttaagccaagcgacaaactttacttgccggaggcagacaggattaacctgtggtaa

SEQ ID NO: 1875 - DNA, 1986 bp, Prevotella sp.
atggaagatttggaaaaagacggagtacggctgccagacaacgcattccgcgaactgaaagagggcgaggaataccgcccggtgatggacccgcagaaaacctatccggaagtgaacggttggtcggtgacgtggggtgtgcttatgacaatgctgttttcagcggctgcggcatacttaggactgcgcgtaggacaggtattcgaggctgcaatacccatagccataattgccgttggcgtatccacggctgccaaacgccgcaatcctttaggtgaaaacgtcatcatacagagtattggcgcgtgttcgggtgcggtagttgccggtgccatcttcacactgccggccatttacattcttgaagacaaatatccaggcatgggtgcctcgttcatcgaaatattcctcagctcgcttctcggaggtgtactaggaatactgttcctcattccattccgcaaatacttcgtcagcgacatgcatggcaaatatcctttccccgaggccacagcgacgacacaggtactcgtgagcggtgcaaaaggcgggaaacaggccaagccgctgttgcttgccggactcatcggaggactttatgacttcatcgtggcaacattcggctggtggaacgagaacttcaccacccgcgtgataggccttggcgaaacacttgccgacaaggccaagcttgtattcaaggtcaacacgggtgccgctgtgctgggcttgggctacatcgtaggtctgaaatacgcccttataatctgtctcggctcgctggccgtatggtggctcatcgtcccgatcatggctgttttattcgacggacaggtgttgagccaatggaatccgtcaatcaccactgccgtgggcgacatgtcgcctgaagagatattcacatactacggcaagtacataggcataggcggaatagcaatggccggaataatcggaatcatcaactcttggggcataataaagaacgccgttggccttgcagcgcgagagatgcgcggcggcaagaacagcggtaaacagttgccacgcacacagagggacattccgttcaagattatcgccattggcgccatcgccactataataataatattcctgttcttctggtttggagtaatgaatggcaacctgcttttcgcctccgtcggcatactgctcgttgccgttatagcattcctctttacaactgtcgctgcgaatgcgattgcaatcgtcggctccaaccctgtttcaggaatgacgctgatgacgctcatccttgcctccgtagtaatggttgccgtaggcctgaagggtaccggcggaatggtcgccgcacttatcatgggtggtgttgtctgcacggcgttatcagtcgcaggctctttcgtaaccgacctcaagataggttactggctcggcaccacacctaagaaacaggaaacatggaaattcctcggaactctcgtatcggcagcaaccgtaggcggcgtaatgattctgcttgacaagacttacggatttgcaagcggccagctggccgccccgcaggccaacgccatggccgcagtcatagacccgctcatgaacggagtcgaggcaccatgggtgctctacggcatcggcgcaatcatagcaatcgtgcttactatctgcaaagttccggcactggcttttgccttgggcatgttcatcccaatagagcttaacattccgctgcttgtcggcggagccataaactggtacgtcaccacacgctctaaagacgccgagacaaacaaggaacgcggcgagaaaggtactctcattgccagcggattcatcgccggcggagcgctcatgggagtggtcagcgccctgttgcggttcggtggcataaaccttgtcaacgccgaatggctggctaatcctttgtcacaagtctgtgcgctcatagcttacattctgttaataacatacttcgtcaagagcacaaagaagtcttaa

SEQ ID NO: 1876 - DNA, 1203 bp, Unknown
  Description of Unknown: Clostridiales sequence
atgacccagaattatggaaccaatcgggttttagaaccgcagcatgttctccctacctctgcatggcggttggacaactgccgagctctggctaaaggggaaatccgcgtggatataaagcggatacacatcgagggaaccagctttaaacagatctgtctggaatccaacaacaacgagcagcgcatcaaacagaaaatcatggacatcgtgatccgcagaggcaagctgcacaatcctgtcacggatacgggaggacttttttacggtattgtttcggaaatcggagaagagtacgacaataaaaagaactttgcgccgggagaagaggtggtttgcaacgcctctctggcttctgtgccgatctatatcgataaggttctgtccgtggaccgggctttcggccaggtggaaatagaaggctatgcgatcttgtataacgaagtgcctctggtgcgccgtccggagggcattccgattaaccttctgctgttcgcgtttaacgaatcgggaacactctatcgaatcagcaatacggcggtaggaaagagaaagtttttgatcgtgggaaacaacctgctgtccaaccttctgttcggctatgcggtcagaaaggtagcgagagaagacgcggaggtggtctgcctgttggacaaaaaggcggatatcgtgctgaaaggaaagtccataaacgacctgatcgccagagtatttacggaagttcactatgtggatatccttaagcccctcgaatgcctcgccggtctgaatgccgactcccttttcgatctctccataaactgcgcggatataccgggtgcggaaaccattaatattctggccactaagagcggcggtacggtggtatttgccaatctgatcaacaactacaatatcgccctctatatcactgaatcgatctcccgtcagctggatatccgatgtgccgacggctatctggaagcttatgacgagttcgatatagagattgtaaaggatttgattccttacattgaaaacgccgtaacgaccaacctcagcgtggatgacgatccggcttatccgatcaaccggcagaccaggctgatggaagcgtcaggacagcgtaagaccatgctggaagattttgtgtgtgaaagccacgccatggcgtctgttctggatgaaattctgactgtagccaaatatgactgtaacgttctg

SEQ ID NO: 1877 - DNA, 732 bp, Unknown
  Description of Unknown: Clostridiales sequence
ggatcgccggcccacaccataaagacctttggcgtggtaaaccgctacgatctgcaggaggaatttccggcgcttaccctgcggccgacagcgatcaaatcggctgtggacgagatgctctggatctggcagaagaagtccaacaacatcaaagatctgaacagccacatatgggatcagtgggccgatgaagagggttcgatcggaaaagcctacggttatcagctgggaatcaaatacaagtttcaccagggtgagatggatcaggtggacaacgtgatctggcagctgaaaaacacgccttattcccgtcggattatgaccaacatctacaactttgctgacctttctgaaatgggactggaaccgtgtgcctacagcatgacgttcaatgttaccggaaacaaactcaacgccgtactcaaccagagatcgcaggatattcttgcggccaacaactggaacgtagtgcagtactccgtgctggttcatatgctggcgcaggtctgcgggttagtaccgggggaactggttcacgtcatcgccgacgcgcacatatacgatcgccacgtgccgattatcgaagagatgataaccaggcctcagtatccggcgccgaaattcaggctcaatcctgaggtaaaggatttttacgatttcaccacagacgacctgatcgtcgaggattaccagaaaaatccccagattaagaatatacccatcgccgtatag

SEQ ID NO: 1878 - DNA, 1713 bp, Unknown
  Description of Unknown: Clostridiales sequence
gcagaaatctgcaggtgcagcctctttgccgttctgattggaatcctgggcggatgcgctttggcatggatcatcggcacggttttcaagaaggtgatgcccgaagtgaccacctatgggttctctctttccgcgtccggactgatcatgagtcttctgtatgcagcagctcttttgatcatattggccgttttggcggtcagatccatgaaacgaagcaacattatggatatcctcaacgagcagagaaagcaggaaccgctgaaaaagatggtcaataccggttatctgatccgcggaaccgtttttctcgttctgggcgtcctgttgggctttgtaatgcctaccgtagtggtgaacctgactaagcattatctcggagcctggaccaatctgttttaccttctggctcttgtgggcttgtatcagattttggtctattctatttcctgtcacagacggggacggaatccggaaaagtattaccgaaatgtgatatcctacgggatgctgaagtttcagggccgttctattgtgcgaaatatgctggttatcacgctgctgctgatgggaagcctgttcgccgtgttttatgtgccggtgaacaatgtggcggcgggcagcactttatccgcctatgagtcgatgtacgcttatttctatacggaagatatggagggattttccaaggaggatgtgcaaaagatggcgtcaaactacggactcgaggtggaaaacttccgggaagcggagcttgtacaggccgtgggaagcggtgtcaaccgggataatgtggacgaaaacggggatttagaggagatttatgaggaaaaatatcgggtgtatgagtttatcagcgcttccgattttgaacggatgaccggtcagcagacagacatcgaatcgggttcctattacatgatacagcgcagcgacgcggaagaaagtcttttcttccattttgacgatatggatcaggtatatctggacagagaagaccgtttcatgactctgcaatacgagggaaatctgaactatgcgtcgctggttcaggggcgtggatttgacagcgaagctcgatttgtggtcagtgacgaggactacaacgagatccgacggggaacaggcctgtttccgcgggaaattcaggtcctctttgacagcagaggcggagacgagttgaaattttcggaggaattttaccgacagttcggcacggcggctgcagaagatatgaaagtctgcggcgcctatgaccagtgggcggcgatgcaggccgatgcgtccggagaggaatacggctatgcagatatggtttcttacgatccggaaaatccgatcctcgaagcggactggcagtacgagccgaggctgattcctatggaggaggcttatggcacggccagttatgcggtattcctgatgctattcctctatgtggcggcggtatgtctggcttctgttggcattgtggcctatgccagaagtcagagtgtgggaatttccagtgcgccggtattctccgatctggagaaactgggagccagccacggttatctttgcaggctgctgcggcagcagatccgaaaggtttatgtgctgccaaccgttttgggctgcactgccatgtggctcttccagttcctgcttttgaatatgaacgatgggagacttacggattcggagctgcagaccatgctgatctgcacggcc

SEQ ID NO: 1879 - DNA, 1530 bp, Unknown
  Description of Unknown: Clostridiales sequence
ctggtgcctgaaggcatggaaaaggtttatgatatcggcgagagctcggtggacatgaacagcctgtacaacatcgcggaaaagctgggcgtctacgatgagttctcggccagggaagccaacgaggcgagaaaggaatactactacctgaattccagtatcgataagctgctcaatgaaaaagagagcatgacggacaagatgaacacgctgatcaggctgatgaatgaaggcatcatcatcgtcgactcggtggggaggatctatctggccaatgaaaaggccagtgaactgttgaaggaacgctccaaggttctccttgggttcaatatcgaagaaatactgccggagcttgatattaattccaccaaagataagttgatcaaaacgccttcggccaatctggtggcggcttcggtggagatccgttctaaggaagaaatcgtggggcatatcatcaccctcgccgactttgaagaaagagaagaaagacagcacggcatgaggtcctcgctgcgggagaccagccatacagccagatatcactttgaggatatcctcggagagagtccggttatccgcagagcggtcggcagcgccagagaaatcgcaggatctgacggagcggtgatgattacgggagagagcggaacgggaaaggaaatgttcgctcagagcatacataacgcctcgagcagaagaaaatacaattttgtagctgtaaactgcgcggcaattccggagaacttgctggagagtgagatgttcggctacgaagagggatcgtttaccggggccaggaagggtggccgcatgggcttttttgagttggctcacagagggaccatatttttggatgagatcgcagaactgcccctgcagcttcagtcaaaactgctgcgcgttctggaagaaaaacgagtgatgcgggtcggatcggatcgcaatatcgatatcgatgtacgcatcatttccgccacaaaccgggatctgttcgttatggttgagaaaggcgagttcagagaagatctgtactatcgcctcaacgtattgccggtttttgtcccgcctcttcgggaaagacgggaagatattctcctcatctttgatgcgctcgttcggggaatgaacgggaagatagagctgagcgatgcagcgcgggatattctgcttcatgcttcctggcgcggcaatgtcagggagctgcgcaatgtagccgagtttctggtgagcaagaggaaaagctatatcgaagcagaggatcttccgccgatgcgcagcgaattgcggcgcagtccggagaaaagagcagaagccgcccgatctaccgtcatcgacaagtttctcctcaacgaaggtcgcgatattgagatgtatcggacagttttgcgggtactcagcgaatcgatgaaacggggagaaaggtatggacgacgtaggttgaccgaagagatcaacggcgaaggcgatctgtataccgaaggggaagtgcgtaaggcgctgttcaagctgtcctcctatggatttgtc

SEQ ID NO: 1880 - DNA, 1875 bp, Unknown
  Description of Unknown: Clostridiales sequence
atgtttttggaaaaaactgcttatgacgacgattttcctatccagatccgaattgtaaatattaaagaatatccgattcattaccatcaggatatcgaaattgtattcgttctcaaaggtgaaattcttcttaaaaacggaagctgcacctaccgccttcacagcggcgatgtctttaccaacagcggccgggaggttcacgccatgtacagcaacggaaaagaaaacgctgtagctatccttaagatcagcaatcgttttttcacccatttctttcccgaactctccaaaagctgttaccgcacctatgaagaccgggaaggcgatcggcatttggactgtctgcgcaaaatgctgcttaatatcttctttgaatccctgaaaaaggatattaattataaacagacatgcattgatcaggtcatgaatctgatcaaatatctgaatcagtacttcaatcttttctcttttcagaaggccatggctgtcacttttgccacggacaatcccgtcatgatcgaacggatgagccgtatcatcaactatctctatgaaaatcacgcaagaagaataacccttaaagaactggctgatatggaacacctgagtactttttatctttcccacatgatcaaagagagcacaggcatgaattttcgagaatttctttgtttcgccagaatcgagtggtccgaaatcgatcttcttggaacgaataaaaaaatcagcgctatcgcaagagacgtgggtttttccaccacgtcctattatgagaaatactttctcaaatattttcatcacacgccgtcggagcatcgtcagaaatattcttcctatgtggagagtccggcccgacctgtaaatgaggaaccaatcgaagagaacagagcctttgatattgtaaagcgatatctgtcacagctctattcagaagataacaatccttctcagattcagctgacccgtctggatatcagcgccgatgcctgtgagaagccgatccggcttctcactccacaactggaactttccatctcgctggaagatttccacgtgctcggaggacttttgttcaacatgataaaagaactgaactgtaaaagcatactgctgcgaacatctccctccgatgaccctgccgctctgaaaaagctgatcgcagatctgaagtcctgcggctgtgctgtaacagaaaaggaagaatctgcttaccgctatttgaaatcttacggcttggattccatagccgctgtcttttatcacatgaaaaactgcgtcacagatgaacgcctgtttttccgtttgcgcgacagcggagaaaaaaactgcttcctgaagggtcagcctgcgcttcttactgccagcggggttcccaaagcggcatattatggtgttcagctattggcccgactcaaaggcgagctaatcagctggggcagaaattttattcttctgcggccttctgaagctccggaaacattcctcgttgcagtttataactacagtgatgagatctatcgactctgcgctaaggaagccactatacacgaaacttatgacgtaatcagcaactttcatgatgaactggatatcagcatcacgataaaaaacatcttcggagagtatatcgtcactaaaagctctctcgattaccataacaatacatttgattttctgtccaagctgggatttccagaaagattggaacttacggataactctccgtttcactattatgtaattccggatgccgacgtacggacagaaacagccgacaaaactctgtccctgagcttttccataaaaggcgctggaatgcagatcgtcaatattcaaaaaagtctgcaaataaaaagtcaagcagaacttaatgaa

SEQ ID NO: 1881 - DNA, 1542 bp, Unknown
  Description of Unknown: Clostridiales sequence
atggacaaagaaatgatcatcgttctggacttcggaggacagtacaatcagctgatcgcacgaagagtgcgggaatgcaatgtttactgcgaagttcagccttatacgatttccattgaggaattgaagaaaaaaaatccgaagggaatcattctgaccggcggtcctaacagtgtttacggaccgaagggtttgttccctgaccagcagctttgggaaatgggtattcctattctgggaatttgctacggcgcccagctgattacctatgtgttgggcggaaaggtttcaccggctccttccaacgaatacggaaagacggagatcctggtcgattccaaggagtgcctgttcaagggcatggaggatactgagatcatgtggatgagccacagcgatcacatcgagattatgccggaaggctttcatgtgacggctcacacgacggtatgcccggtagctgccatggaaaatccggagaagaagatgtacggcactcagttccatccggaggttatgcactccgtaaagggaaaagagcttcttgctaatttcgtttacggcgcttgcggctgcaagggggattggaagatggattcctttgtggaaactaccgttgacgagattagacgcaaagtcggcgacggaaaagttctgtgcgcattgtccggcggggtcgactcttcggttgccgcagtactgctttccaaggccgtaggaaaacagctgacctgcgtgtttgtcgatcacggtctgctgcgtaaaaacgagagtgaagaggtcgaagcggttttcggaccggaaggcccctatgatttgaatttcattaaagtcgatgcgcgtcagcgtttctatgataagctggcgggaataaccgatccggaggcaaagagaaagaccatcggtgaggagtttatccgtgtatttgaagaagaggcgaagaagatcggcgccgttgatttcctcgttcagggaacgatttatcctgacgtgatcgaaagcggtctgggcgagtccagggtgattaaatctcatcacaatgtgggaggacttccggactatgtggactttaaggaaattatcgagccgctgcgcatgttgtttaaggatgaggtccgcaaggttgggctcgaactgggaattccggagtatctggtattccgtcagccgttcccgggaccgggcctgggtattcgtatcatcggcgaagtgacgccggaaaaggtgaagatcgttcaggaggcggacttcatcttccgcgaggagatcgcgaaggccggattggataaggagatcaaccagtattttgcggcactgaccaatatgcgttctgtgggcgtcatgggcgatttccgtacctacgattatgccgtagctttgcgtgcggtgacgaccagtgatttcatgacggctgaagcggcaaaaattccgtgggacgttttggaaaaggccgtttcccgaatcggcaacgaagtggatcacgtgaacagagtattttacgattgcacagggaaaccgccgggaacgatagagttcgaataa

SEQ ID NO: 1882 - DNA, 831 bp, Unknown
  Description of Unknown: Clostridiales sequence
gtgctcttatataatgaaagccattatacttctttcggccgctttgaaaattaccccatttttgtgaaagaaggaacgcattctatgaataagggaagtagttatatgagcagcgaacacgaaattgtccgccaggtctgtctggcaaaggaagatcccgatgcagcggaccaattcctccgcgactatatgccttttatacggtcggagacatccagatttctgcagcgttttccttcggcggaatacgatgatgaactgtcggtggccatgatggcttttcacgaagcgataacgggatatgccaaaggccgcggagcctttctccaatatgcggctatgctgatacgcaatcgtctgatcgattatcaccggagggaaaagcggcacagaggcaatctctctatggatgtgccggcagaagaagaggacaggaccatcggagaaacgttggccggagaaggggatcacggcgaagaactgattctgcgagaagcaacccgtgcggagattgaagcgttctcccggaaactcaccggttttggcttttctctttcggacatagccgacaactgcccgcggcagaaacggaccatcgccgtctgccagaaggcgatggcctgcgctgaaaaaaatccggatattgcagccgatctgctgaggacaaaacggctgcccgttgcgcgcctttcccttgaaaacggcatcgaacgaaagacgctggaacgccacagaaaatacataatcgcactgattctgatctgttccggcgaatttgagattatacggggacaccttaaacaggtgctgaaaggaggagcgtcaaagtga

SEQ ID NO: 1883 - DNA, 1128 bp, Unknown
  Description of Unknown: Clostridiales sequence
ctctattccggtctggtcaccattattctggacggctttgacaagatcatcattgccgacgtcagacggtatccgcagcgaggggtggaggagccggaaaaagaaaagacgctccggggcgcaaaagacggttttacagaaagcttcatggaaaatctggggcttatccgcaggagaatccgcgataaccgtctgatcttcaaaagttacgttatcggagaaaagtccaaaaccgacgtcgccctctgctatatgaagggagtggccgacgcagaccttgtcaggcgcatcgacgaaggcctttccatgatcaaaatagacagcatatccattggcgatcaaaccctgatagagcagctgatcatacagctcaaaggcgggaaaaggagacactggatcaatccgtttcccaaggtgcgctacacccagcgaccggatattatcgccgctcatttaaccgaaggaaaactggctataatcgtggacaatacgccgacggtcatcctgctgcctgtcggaatcttcgattttacacaggacgtggatgactactactttcccatccttacgggaaactaccttcgcttcctgcgcattgccaatatgctggtcatcctgctgctgacgccgctctacatgctcatcgtggataaggatcttcccatgcctacagatctgaattttatcataccccaggacccctttgcgctgcctgtcttctggcagttcatcatcctggaactggccatcgacggtctgaaactggcttcattgaacacgcccgagtccctgggaatgtctctctccgtcatcggcgcgctgattctcggtgagttttccatcgattccggctggtttatcccacagacgattctgatgatggccgtggtcgctctcgcttcctttacccagcccagcatcgaactctcttacggtattaagttcatccgcgttctcactctgattggctgtcgcctcctcggcacatggggactggccgccgggcttgcagcaggctttgtaatgattgcttccaccaagactctcagcgggcattcctatctatttccgctgattcccttccgctggtcctctctgaaaaagctcctcttccgcacagcaaagtaa

SEQ ID NO: 1884 - DNA, 1461 bp, Unknown
  Description of Unknown: Clostridiales sequence
atgatgagaagaacgaaaattgtatgtacgatcggtccggcgtcaaaggatcgggaaacgctgagacaaatgctcaaagcgggaatgaacgtggcgagagtaaacttttcccacgggacacatgaggagcacgcggagaccatccgcattttccgcagcgttagagacgagctgggaatacctgcagcagttcttctggacacacggggaccggagatacgaatcggaaattttgcaaacggagaagaaatcctcgaagacggacagatctttaccattaccacagaggacgtggaagggaccagagaaatcgtatccgtatcctacaaaaatctgccggatgaagtaaaaccgggcaacttggttctggtaaacgatgggaaaattgtgatcaaggtaacggagaccactccttccgaagttcgaggaaccgtgcttcacggcggaaagatcagcaatcacaaggggatcaatctgccaaacgtaaatctgcgtatgcagtacatgagtcagcaggacagagaggatatcctgtttggaattgagcacgatgtggactacatagcggcatcctttgtacggtcggccggcgatgtgaaagaagtgcggaatctgcttgaccaaaacggaggaaaggatatcaaggtcatcgccaagatcgagagcacgcagggcgtggaaaatttcgaagaaatactgcagatcgccgacggtatcatggtggccagaggcgatatgggcgtagaggtggcttacgagaagctgccgggtattcagaagcgatttattcgcaggtgtgtacagtcgggaaaaatcgtcattacggcgactcagatgctggaatcgatgatcaccagtcctatgccgacgagagcggaaatcactgacgttgccaacgcggtctttgacggcacttctgccgtaatgctttccggagagaccgcagcaggccggtatccggtagaagcggtggaagccatggccagaatcgcggttcaggcggaggcggatatgccgcagatatccggaaaggatcaggtttggcacgaaatggacagtcacgatgtgaccaatgcggtcggtcatgcggcctgtacgttggcaaaggatattcgggcgggggccatcatggcgattaccaaaaccggctacaccgcaagacgtatgtccaaattccggccgtacatcatgctcatcggcgctacgccatacgaaaaaacatatcaccagctgtctctggtatggggcgtctgtccgattattgctcattacagatacgaaatagaggaactctttgctcattgcgccagaaaggccattcgggcaggtctcattcaagagggagaccgggttgtgatcagcgcgggacttcctgtagatgttcccggcaataccaatatcatccgggttatggatgcggtcttaggggactccaaaagcggcaaatctgctgtagattaa

SEQ ID NO: 1885 - DNA, 1557 bp, Unknown
  Description of Unknown: Clostridiales sequence
gtaaaaaccgcaaaggccgatgggctgaccttcggcagcatggcgaggctgggcgtgcggaatacgttcaatatcccggccaagtttttactgcttctgaccgtatttgtgttcctgtgctttgccgttatggctcagtacgcttcctttatgaacatgggagaaatgaatacgggcggttacaacaactatttctccgataccagcaagaatcggattctgattaccaaagatgaccgcagcgagtttaccgatgaagactacgccaggatagaatccatgtccaatgtggaccgaattgtaaaaaacgatctgatgctggatctggtggccaatgtgaccgacgatccggaaaacggagacttttacatcgtgtccaagatcgaggaactggaagactttgaaggcaaactggtcaagggacgcatgccggaaaacgacagagaggcggtacttttctttccggaaggcggttatgcggaaaacgttatcgatatggcatacggcaaagaggccatgctgaccgatcagaacaccggcagcgatctgatgaaggataaggtgaaaatcgtgggctacggtctgctcgacgatcgacagacggaagccatggaagagggcggctactatctcgaagcctacctttgcatcaatgaagagggaatgtccgatgtccgcatggcggccctggagcgctactgcacccaggagatccattttgccggacacatcctggacggcaattccgcatccggtatgatgccgattcgcgcgtcagaaaacgtgcccgaaggggaaatttacgtatccgaagacatagccgcgctggcacagggaagcgcggcgggatcagaactttctattgtcaacaagagcctgtacttcgaggatcgctttaccttcgaagtgggagcggtctacaacaaggacaatctgaaacagtacctgaatctggatgatttcgaagcagtcagcggaacactgttcatcagtccgaaggattacagcaggatgttcgaaaagggcaacttccagtccagcgtcatcgtctctgacgataagatcaccgcgcagacggcggaatccatcgctgaagccggctatgaaaccttcgtggtaaacgacggagtggtcagctatgcggaaggtttcgatgtcatactgaatactttcaggaccatcatgttggctgctgtgctgatcgtgctgttcttcatcacttattttattaccaagctgatcctgaagtcgagaaacgtgtatttctccacgatcagaatgctgggtgcgacgaaggagaactgcagcggtctgctgaaaaccgagctgtttactgtgttcaatatcgcattctttatctgcctgggattcttcctgctggtcaagagcggaaacatcaactcggagtacctgacacagctggcctccttccttggagcgggagactttgtgctgctctatatcgtgctctgcctgatgtccatacttctggcggccaggtatgcgcgccagctgtttaagaagactgccatgaacgcttataaagaggaggtgtaa

SEQ ID NO: 1886 - DNA, 1539 bp, Unknown
  Description of Unknown: Clostridiales sequence
atgaaacacatttttagaaatctgattccctattggaagtcgatcattgcgatcatactgctgctgatggtgcaggcctactgcgacctgtcgctgccgcagtatacttctgatatcatcgacacgggaatccagaacagcggtgtagagcacatcgttccggaaaagataacggacaaagagttcagagaagcccagatttttatgacagatgaagaaaaggagttatgggagagtatttatgatgatcagggtcaggtccatgcgctgaatgtgaccgacgaagaggaactggatcgaattgacagcgaactgatgacctctatcgtgctgacttatcagttggggcatatgagtgaaagcgactttaaagatacggtaaagcggtccgtagaaaataattcccagtatggccagatcgcagagcagatcgacgacatgtccattgcggatatcgaacagcttctgcataccgatatcgatacctttgaggctgaggatgaagaaggcaacaaagctacttatgtagatatgcggccgctgatggaatctatgattcaaagcggacagatggatgcctcattggtggaccagtccagaaagaccatggaagataccatcagctctatcggcgacgaaacgctgtcatcaatgggaattgcgtatgccatttcctgcgatgaagctgcaggaataaatatcaacgatgtgcagatgtcctacctgtggtcagagggactcaaaatgctcatgatggcaatactcatgctgatcgcggcagtaatcgtttcctttattgccgccagagtaggcgccggtgtaggaaaagagctcagaagcagggtgttcagcaatgtagtcggtttttccaatgcagagattgacaagttttccacagcttcactgattaccagaaacactaatgatatacagcagatacagatggttacagcgatcatgctgaggatggttttatatgcgccgattatgggtatcggagggatctataaggtgtatcagaccggcgcgaatatgggctggatcattgcactggcagtgttagtcatcgtgggatttgttctcctgctggtttctgtcgccatgcctaaatttaaagtgatgcagaagctggtagacgcgcttaatctggtttcacgggaaattctgaccggcctttccgtaatccgggctttcggcagggaaaaaaccgagacggcccgttttgacgaagcgaataccaatttgaaaaagacccagctctttaccaaccgggtgatgacctttatgatgccgggaatgatgctgattatgaattgccttgtagtgctgattacctgggtatctgctcaccgtattgatgacgggtcgcttcaggtcggcgcgatgacggcttttatcacctattcgatgatgatcgtcatgtcgttcctgatgctgactatgatgtcgatcatgctgccgagagccggtgtagcggcagaacgtatcgacgaagtcctgcagaccaggacttctgtggaagatccaaagcagcctgta

SEQ ID NO: 1887 - DNA, 1350 bp, Unknown
  Description of Unknown: Clostridiales sequence
gaaatggagcggcttggagaacttgtacggggtttttcttctgtgcgcctgactgcaaaaaaagaagaaaaggaagcctacgcgcagataaaagatctggcggccgcctgtaggaagaaggcgtcggcgctggtaaacgatgtgaagaacttgctttttttacaggacttcgacgagcagatcggtgaaatgaatcagacggcgccgaaagctcgtatgcttcaaaagctgcttctcgattttgataggattttccgggaaagaaaaacggagaaaaaactgattgacttcaacgacatcgagcacctctgtcttgacgtactggaaaacgaggatgccgcttcgtactatcgggaaaagtttgcgtatatctttatcgacgagtatcaggataccaatatattgcaggaagagatcgtatccagaatcaggaaggaaaacaatctcttcatggtcggagacgttaaacagagcatatataaatttcgtctggcggaaccagagctgtttaaagaaaagtaccggctttacagcagcgaaagcgatgtatcggcaaagatcgatctgaaccggaattttcgaagcaagtcggttcttctgcacgagatcaatcgggttttccgcggtctgatggaggactatgacgaagatgccatgctgtatccgggagtggattacgacggtccctgccagtatccaccaaagctgagagttgtggatacatccggcatcgatgaggctgatgaagagttgagcgcactgaagaataccgagattgaagccctcgagactgttcagatcattcagcagcttttaggaaagccttattacgatcacaaaaacggcgcggaaagacggattcgtccgagagatatcgtaatcctgatgcgcggcgtgaggaattacgccgaagtgttttatcagatattgaaaacgaaaggaatcgacagttttgtcgacgacagcgaaggctattttgatacgatagagatcaatgtattcatgaatttactatcggtaatagacaataagatgcaggatgtgcctctgatcagcgtgctgcattcggagatttttcgcttttcggcggaagagctggggcagatcagaagcctctgccgaacgggtccttactgggaagccttttcctctgccacagaggaagagggtcctcttggcgagaagtgcagaaaggcggcagactgtctgcatcggtggaaagcggccgcggtaagtctgccattgggcagatttatctggagtttgcttctggaaaccggttattacattgaagccggcgccatgcccggcggaaaccagaggcaggcgaatctgcgggcactgatcgac

SEQ ID NO: 1888 - DNA, 717 bp, Unknown
  Description of Unknown: Clostridiales sequence
atgataacctttaaaaacgttactaagatttacaataccaacgtcggccttgaaaacgccagcgtggatatcgacaagggggactttgtctttctggtcgggcccagcggagcgggaaaatcgacgtttatcaaattgatactgaaagagatcgacgcggactcgggaagcattattgtcgacggacaggaagtgactaccctgagcaacagggagatcccggaactgcgccgtaagatcggcatcgtatttcaggatttccgtcttctccccaaaaagacagtttacgaaaatgtggcttttgccatggaaattctccatcggaccaagcggcagatccgaaaaaaggtaccgcaggtcctgagtcttgtcggcatcagtgacaaagcggataagtatccggatgagctgtcggccggcgaacagcagagagttgccatcgccagagcgattatcaacaatcctacggtgttgattgccgacgagccgacgggaaatctggaccccgacacggcggcggaaatcatggatcttctcaaccagatcaacatgaccggaactacgatcgtgatggttacccacgcgaaggatatcgtggaccgtatgcagaagcgggtagtggccatcgaagccggtcatatcgtcagagacgagctgggacagtacggctacgaagaagagagcggcatcagggaggaggtctttgacgatgagtag

SEQ ID NO: 1889 - DNA, 837 bp, Unknown
  Description of Unknown: Clostridiales sequence
acgctgcgcagactgctttccatgaacaggaagaccaagaagatcggactggatatcagcaagccgtttaccaaagagattctggccgtattcggcggaagaatgcgggttctgatttccggtggagcagccatcaatccggaaattctgcagttcttcaacgatatcgggattatttccgtccaagggtacggactgaccgagtgttcgccgatggcggcgctgaatccggatgttccgaaagatatgcgcaatgcttctgtaggccatcttctgccgggaatggaagtaaagatcatcgacaaggatgaaaacggcatcggtgaaatctgcttcaagggcgacaacgtgatgatgggttactatcacaatcaggaagcaacggacaaggtgctcgtcgacggttggttccacagcggagacctgggttatgtagacagcgaggatttcatctatattaccgggagaaagaaaaacgtgatcattacgaagaacggaaagaacgtatttccagaggaactggaataccatctcagcaacgtaccgtatatcgcagaaagcatggtctggggcgacgagggtgaagacgggtccaacgatacttcgatcatcgccacggtgactctcgatgcagaggaagtcgtggaaaagctgggtgagaactacaccgaagagcaggctcgggatctgatctgggaagaagtggataaaatcaacgaaaatcttccgtactacaaaaagatcaagaaggtcaaaatcagaaaagaggatttcgagaaaaccaccggtaaaaagatcaagcgctttgttgattccaacaaagaggagagtaaatag

SEQ ID NO: 1890 - DNA, 1398 bp, Unknown
  Description of Unknown: Clostridiales sequence
atgtcttgcttaacgcagaaaaatactgaaataaagaaggatgaagacatgaacatagctattgtgggcgccggaaaacttggctataaagtagctgccgcactttccggcggagattattcaatcaccattctcgataaagatgaagctatcctgcagaagatctctcagcagttggatgtgatgacgatcaatgcggatgcgaggaacatctccgtcctaaaacagctaaatatcgagacgttcaactatctgctggcggtaactgacaacgatgaaaccaatattctcatcgcgtccttcgccaagactctcggctgccggcgcgtcatcgccagagtccgcgaaccagaacacatgaaccagcttggtttcatcaaggaaacgatgaagatcgattcgatcatcaatccagacttcgccattacggtagagatctacaaatatctggttgaaaagtacactctgagcaacggcatcttcaccagcggaaaaattgcgctgatcgaatttccttcaaaacgatatacaaagctgatcggtctctctataccggaagtccgcagcatgcttcctgaaatgctggtcgtcgccatttcgcgaaacggtaaagtaatcatccctcacggcaacgataagatctgccagaacgattacctgtatatgatcggcgaaaaagataaaattatcgcactgaacaaaaaggtccacgaaaaaggcaaatataccaatgttcacaaggtcatgatcattggaggcggaaaaaccggattttaccttgcggaaaagctggccgagttcggcgccgcagtaaagctgatagaaaaaaacaaaaacagatgccactatctctctacccatttgaacaacgtcatggtgctccacggagacggcacagacatctcactgcttgaagaagaaaacctgcacgaaatggacgccttcgttacagctaccggctacgatgaggaaaatcttctgctggcgctcaccgcaaaacagcacggcgtagaagacgtaatctctaaggtcagccacgaaagttacaaggatctgatcgaaaaaatgggcgtggatatggttctcaatccattggatataacggcaagcaacgtgctgcgctttgttcagggatcgaaaaagatcatttcttccctgctgattcagggccaggccgaaatcatggaaatcgtggcccactcccacatgaaactgatcggggtgccgctgtctcagctggagcttcccgacggcgtgctgatcgccgcaattcaccgcggccagcaagtcattattcctgacggaaacacaaagattcagtggaacgacagagtcatcatcctgaatctgctgtcagaaatcggcgatatggagaaattattgaagaataagaattag

SEQ ID NO: 1891 - DNA, 1908 bp, Unknown
  Description of Unknown: Clostridiales sequence
atgaaggatttaatcgagaagagcatacattgggattccataggagagcattcttcggatgaataccggtacgagattattgacgcgagcattgcgaaggattccggagtgttgaatataacactccggcttaattttgtgccgccttatctggacatggagaagctgaagggcatgatcctgcacaggattgaaaaactgcgggatgtgcggttttcttatgtctacgaagatgtgattctgcagcaggaagagatcatcagattgtttattcctcatatgattgaaatcatcaacggaaagtacgcggcgattaccaagacgattcaggcggacaagtttacctacgacggacagaccctgtccatctttgcgctgggaagactggctacagaacagctcaacgaaaaagtggcccgtctcttcagcggtctgctcatggagcactttgccatcagtgcggaggttgtctttaaaaacgatcaggatgtctatcggaaggctgcagaagattggagaggctcggaggaagaagacataaagagcagtctcagagagcagatcagaaaaaatcaggaggctcaggctgcctcgccaagcaagcctgcggagagcagcagctttggcggccagaaaaccggatggcgcagacgggagaaggagatgcctgcggagggaaatcggattatgggaaaaccgattgtcggggaatcttcacctttaaccggattgtcggccgattccggtatggtgatcatcgaaggtatactgtttaaaaaggattccaggcccataaaaaacgagaaaaaactggttacccttctgattacggacaagaagacgtcggtatgcctgaaagcgttctgctcaaacggaaagtgggaggaaatcgattctctgctgaagaacggagactacataaaggttcgcggcgagacggagtgggacagatacgacaactgtctcgtcgtgatgatgaaggatatcgaaaaagggaaacggaaggtcagagaagatacttatggagcagggaagagagtagagcttcacgcccataccaagatgagcgctatggacggtctcaacgaggtatccaatctggtaaagaccgcggcatattggggacagccggctgtggcgattacagaccacggcgtggtgcagagttttcctgatgcggctaagacggcaaaaaaactggaggccgacaaagaaaatcccatcaacattaagatcatatatggtatggaaggatacgttttcgatgacagggactgccgaaatcctgacggcaccatcgattataaaaagaagccgaccaaccacatcatcctcctggcaaagacccaggagggattgaaaaacatatataagttggtttcctactctcatcttcagtatttttacaaacggccgcggctccctaagtcggtgatacaggagcacagagaaggcttgatcatcggctctgcctgtgaggccggagaggtttatcgggcgattgttgaaaaaaagagcagagaggaaatcgagaaaatcgcctcgttctatgactatctggaaattcagccgttgatcaacaaccagttcatgatcgataacggtatcgtatcagggaaagaagaattgcgggagatcaaccggcagatcataaagctggcggatgatctggaaaagccggttgttgcgacgacagacgctcactatgacgagccggaatcggccatttaccggaacatcctgatggcaggcatgggattcaaagacgccgagaacggccaaggcctgtacatgcggaccacagacgagatgatggaggagttcagctatctgggggaagagaccgcttaccgggtggttatcgagaataccaataagattgccgatatgatcgacggcagtatcctg

SEQ ID NO: 1892 - DNA, 1734 bp, Unknown
  Description of Unknown: Clostridiales sequence
atgaaaaattatcatttagagaaaaaattttacgagttccgtgacctgagggagctgctgcggacatccgccgagaaatacgcagacagagtcgcttttgtaacaaagattaaagagaaaaaagaggtgaactatatcaataccacctacgccgatctctttaagactatgggatacctgggaactgctcttatcgaaatgggctacaagaataagcgtattgccgtaatcggcgaaaacagttataattggtgtctcgcttacttttctgtcagctgcggagtcggtgtaatcgtccctttggacaagggattgcagaaagaagagctggaaagctgtctgaaccgaagcagcgcggaagttatcttctacgataagaagcacgcgcaggtgattgagcagatcgccaaggagaaaaccacaggtctttccctgctcatatccatggattttgagtccgagtctgcggtgccgatgatggaactgatcgacaagggacaggaattgacggagaagggagatcggcgatacctggatgcggagatcgatccggattcgatgaattttcttctgttcacttcaggaaccacttcccagtccaaagcagtcatgctgtctcatcgaaactttatgagctgtaattacgggatgaactgtgaagaactgtttttccccgacgatgtaaatatgatgattcttcctctccatcactgctacggcatgtccggtttgctgaccttcttgtcccaggggatgaagaacacgttctgcgacggactgaaatatattaccatgaatctgaaggagtacggcgtttcggtaatcatgagcgtgccgctgctcttagaaagcatgtacaaaaagatcaatagggccattgagaaacagggaatggagggaaaggtgaatttcgctcttaaactctgcagcgtcagcgaaaaggtcggaatcaacctgcgaagaaagatgttcaagacgattatcgatcagctgggcggaaggatgcgttttatcatcaacggcgcggcggctttagacccggtggtgtcaaagggctttaacgatctgggcatattgaccgtacagggctacggcctgacggagacttctccgacgatttccagcgaaacttatcgttacctgaaaccgggctcggtaggtaaactgatgcccaacgtggaaggaaagatctttgaacccaatgaggaggggatcggtgagctgatcgtccgcggagataatgtaatgctcggatactacgacaatcaggaagctacggacgaggtcattgtcgacgggtggtttcataccggagatctggcttatttcgatgaagaaggctacctgtttatctgcggccgaaagaaaaacgttatcgttatgaagaacggtaaaaatgtttttccggaagagatagagaatctgatcaacgtgcttccttatgtggaggaaagcatagtgttcaccagggagaaggccagcgattttgtgctctgggctaaagtcgtttacgataaagagtatctggaagaaaatgatctgaccgaagaacagctgaaggaacagctggacagagatatggatgagataaacgcgaagatgccttcatacaagatggtcaagaaatatttcctgtcggataagccgacaatcaaaaatactacggcaaagaccaagcgaaacgacgagatgaagcagattatgaacgagctttccgagctcggtttatcataa

SEQ ID NO: 1893 - DNA, 996 bp, Unknown
  Description of Unknown: Clostridiales sequence
ggtgaagatcaggcggcggaaaacggtcaggaagccacggaaacgctgaaagtagggatgctgggcaaagacatcaagacggcttgtatcattttggccgacagcctgggctactttgaagaagaaggggtagacgtgcagtttgagaagatcaactcgctttccgacgggttgacggccgtcagcatggataaactggatatcctgcctttcggtgtaatcccaagctgcagcttcatttctcagggaacagacgtggtgatcttcggcggaaccatctctgagggaagcgaagggattaccaaagacgatgtggaatacacccagctttccgatttcgccggaaagacaattggctgcttccgaatggaaactggtcatatggtgttgaagggactgcttcgtgaagcgggaatcgacgcggaatttgtctatctcgaatcttctcaggccatcgtggaagcggtgaaaaaaggagaagtggatatcggtatggtcaacagcggttacggatatgttgcggagcagagcggcgctcacgtggctttccaggtgggtgattttgaaagcgatttcccttgctgcagacagacggcttccagaacggcggtcaacgaaaaacgggacgctctggtaaagtttgaaacggcgctgctgagagcctacgagacttacctcaatgacagagacgctgcgatcaaagcgcttacagaatactcgggacaggaagaagcctacgtagaagcggtaatgtacggtacagacagctacgacaacgcgatgatcgtttctctggatccgaacaagaaaaaggtttcggatttctacgatgtgatgaaggccaacggcgatatcgacgccgatacggaatacgatatcaacgactacatcgatacatccatctacgaggatgcgcttgaggcgctcatcgagaggggtgaacatgcagatctgtatgaagaactgctgaaggaatttgaggaaaacaataaatga

SEQ ID NO: 1894 - DNA, 933 bp, Unknown
  Description of Unknown: Clostridiales sequence
atgaaaaagaaattggcattattgctgaccgttatcatgatcgtcagtatcgcctttaccggatgcgggggcgacagcggcggagaagctgaaggcgataccatcaaagtaggctggatcggcgctctgaccggagacatggctccttggggaaaatgcgaaagccaggcgctgcagatgtacatcgaccagcagaatgaaaaaggcggtgtactgggcaagaaaatcgagttggttacttacgatactaaaggtgacaacaatgaagccgtaaacgcagtaaagagactgatcgcacaggataaggtctgcgcggttctcggaccgaacgcttcagcggcggcaattgctattaagggagccctgaatcagggaaaagttccggatatagcgacagtagcgaccaatccggagattaccgtgaacaaagacggttctctcaatccatataacttcagagtatgcttcactgacccgtatcagggtgctgtagcggcaggttatgcaatagacgaactggacgctaagacggcggcagtactgtacgatgtatccagtgactactctcaggggtttactcagttcttcatagaaacctttgaagaaaaaggcggtaagatcgtagctcaggaaggctgcaagaccggcgataccgatttccgtccgcagctgaccaagatcaagaaagcaaatcctgatgtaatcctgctcccgttgggaagttataaggaagttgctttgagcgccaaccaggccagagaactgggaatcgacgcaactctgttcggcggagatacctggccgagtgaaactctgttcgagatggcaggccctgctcttgaaggttcctatgtagttaaccactttgactacaacgatcctgcagcggcagaaatcaccaagatgtacaaagataagtttgatacaaatccg

SEQ ID NO: 1895 - DNA, 1635 bp, Unknown
  Description of Unknown: Clostridiales sequence
atgaaaacgattctttgtcatgctaaggtttatgtggagaagggctgctatgcccaggctgttctcgtggaagacggtctgattgcaaaggtgggaacagatgaggagatcatgagctgcaaggaagacggcatgcaggtgatcgactgcggaggcaggacgctgatcccgggcctgaacgattcccatcttcactttatgcagtttggggagacgctgaatcaggcgcagatcgacggagtatcttctatcgacgagatgatcaggatatgcagagaattcgccgaaaagcatccggaaagggttcgtgacggactccatgccatcggctggaatcaggatctgttcatcgacgacaaacggattcccgaccgccacgatttggacaagatcagtacggaatttccgatcgtattagagcgggtatgcggtcacattgtttcaacgaacaccaagctgatcgaaatgctggggatagacggagactcgccgcagttcccggatggagattttctgatcggggaggacggatatcccaacggaatattcacggcaaacgcctgcaatatcgccaaggcgataattcctgattttacgctgcaggagagacgggaaattcttcttgataccatgaagtatgccgtttcgcatggtttgaccagtgtacagagtaatgacgtgggaaccacgtttatggacgggcccgctgcgtttaagctgttccacgatatttacgacaaaggagaagccctgatacggtaccgtcatcaggtctgcttcaacgacctggaagccttttccgagtatctggaaaagggagagtttgctcagggaaaatacgaaccggattcctggctgactctgggacctctgaagctttttaaagacggaagtctgggggcacggacggctctgatgaaagacggctatgtgggagacagaggaaaccacggtctggaatggattaaaccggatgaaatggaaaagtactgccagttggcgaaaaagcacaacttgcaggtggtgacccacgtaatcggcgatgcggccatagagagaaccgtagattgttacgagcacgcttttattgacggagagaacaaacttcgccacgcgttggtgcactgccagatcaccgatgaaaagctgctggacagaatcgcagaaaaaggaattctcgtctttgcgcagccgattttcctggactacgatatgagcatagtcgaagagctctgcggaaaggagctggcatcgacttcttacgctttcggcactcttcagcgcaagggcgctcacgtgtcctacggcaccgattgcccggtagaggactgcaatccgtttcccaacatctatatggctgtaacaagaaagaatcggaacggaaaaccggacggaggtttttatccgtctgaatgcgtcgatgtggaaaccgccatagacgcttataccatagaaagcgcctacggcgaatttatggaagatcgaaaaggcaggatcaaggaagggtactacgctgatctggtgcttctggatcgggatatctttactgttgatccgatggagatcaaggatatccttccggtgatgacgatggtgggcggcaagatcgtttaccagagtgaaaccgaaagatag

SEQ ID NO: 1896 - DNA, 1209 bp, Unknown
  Description of Unknown: Clostridiales sequence
gtaatctgcacagtgccggcaacggtttttgccgctgattctgcagagacggaatctccggcagcttctgcgattaccggcgtagatactattgaagatcaggaatggaccggagaagaaattaccatttccgcagataaactgatcgtcagatccgatgataaggttctgaaactggatgaagactacacggtttcatatgagaacaacatcaatgtcggaacagctacagttgtaattacgggaaagggaagttattccggcacagtcagagccgaattcagaatcgtaaagcattttacctccgctgacagaccgacgatcgatatcccgacacagattgtcagcacagaggacccggggaaatccaccttggagaatgcaagcgtaacctggaataatactgttcttaaagaggggacagactatgatattacaggagtagacaacagcaaagctggtacccagactgcaaaggtaacctttaagggattatattatggtgagtttgatgtaaactacaatgtagttaacaaggatttttcaaaggcttccttatacctgaatgatctcagcgcagtctacaccttcgacggaaaggctaaaacaccttctgtaacgatcagggacggagagatcgaacttcaggaaggcgttgactacacggtcacttatgaaaacaatgtaaacgcaggcactgcgacgattaaagttatcggtgccggctcctatgcaggagaactgacaaaggactttacgattaacaaggcgagactgtcggcctgcacaataatctttgatccggatgcctataccgcaacgggtcagccgattacgccgacttatacagtaaaattaggagattataccgttactgccgacgagtatactgcggtttacaccaacaatgtaaacatcggtgaagcaacggcagcgctgactgcgaccggaaagaactttaccggtacgctgagcggtaagttcactattgccgggaagagtgttgctgatctggactgcacattgtcagagacggaatacaactatgacggaacggaaaaaactccgtccgtagtagtaaaagacggaactgtgacgctgaccgcaggaaaagattataccataacttatgaagacaacaggtatgcaggaaccgcaaaagtgattattaccggaatgggacagtatgccggaacaaagacggtaacc

SEQ ID NO: 1897 - DNA, 921 bp, Unknown
  Description of Unknown: Clostridiales sequence
ggcgaatctctcggcatccggcgggccagcgccgaaccggagtacgcggatcgtctgttggacggcagcagggtacatcaaatagatattcagatagaggattgggaggcctttttaaaggaagcggaaaaagaagagtatgcggtctgcagcgcggtgatcgacggagagcgctttcgacagattggaattagaacaaaaggaaacaactccctccacctgacaaaggaatacggggcggcaagatacagccttaagctggaatttgatcactatgtggacggaggaaattatcacggtttggacaaactttctctggacgcttcttttcaggacaacagctacatgaagacctttctcacctacgatatgatggcctttatgggcgtgccgacacctctgtgcagctatacatgggtgagggtcaacggagaagactggggcttgtttctcgctgtagaagaaccggaagaagcctttgcgcgcagaaatttcggcaggaatcacggacagctgtataaaccggattatctgtctctcgacggtgagaacagcgacgtggcgctccggtataccggcagcgatcccgaccgctatgaaaatatctttcgcaacgctaagttcgaaattgatgccggcgataagcgaagagtaattgatgccctccgaaagctttccgagaaagaagatctggaaagctgcctcgatgtggacgaaattctgcggtattttaccgtgcaggtgtttgtcatgaactgggacagctatctgggctatacaggacacaactactatctgtacgaagagggtggaaagctgtccatcctgccatgggattacaatcttgctttcggtacatattctctcggtatgccggaaccggaggaggactcggaagttctgatcaattatcccatcgat

SEQ ID NO: 1898 - DNA, 1338 bp, Unknown
  Description of Unknown: Clostridiales sequence
atgagaaaaaggtggaggctaagagccggaaccgcagccctgacagtttttcttcttctgtcgcaggtgccgctgacggcgtacggtcaggaaatcggcagtgcagacgaggagcgggtcagcggtgaatatgtcgtcgcatccgattgggatctgagcggactcagcgccggcggacccatcgcggaggtgacttttgcgggaccgaatctggcgttggtcagggcagaaaagggcgcgtctctttctgatgtgaagggcgttcttgacgaagaggcagacagttatgagattcagcctaattacgtctacagctcctcggcagtcagagatccgttttattctgtacagtggggactgtacaacaccgaaggcggtgcggacatcgattttgaccgtgctgtttcctttatcgagaaaacgaggccggatatgggacagacggtggtcgctgtcatcgacagtggattcgactacacccacgaagatctggcggataatacctgggtcaatggcgatgagattccggggaacaagagagacgacgataagaacggatatatcgatgacatatacggctacgattttacagcggacggaccgctgaccgattcgcctgcgagcagagagtacgagcacgggactcactgcgcgggaaccatcggcgcggtcagcggcaacggtatcggaattaccggcattgcctctgtgacagacagcgtttcgctgatgaatctgaaagtgctggcgggcagacagggcaccgggtcaaccttcgatctgattcgggccatccgatatgcggaggaaaacggtgcggatatctgtaacctgtccatgggatcttattccgatgacgatattctctatcagacgatcaagtcgtcagacatgctttttgtgtgcgcggcgggaaacgacggattgaatttgtcctatgtgcccatctatccgggctgctacaatctggacaacgtgatctgcgtgggaaatatgcgtcctgccggaaatcttaaccggctttccaatttcagcagcagatatgtggatattgctgcgcccgggacgaatatttacagcaccactccttcgagcacttatgattccatgagcggtacatctatggcggcgccgtttgtttcgggaacggcggccctccttcattcatattacagtcagatcagcgcggcggatcttaagggacttatcttaaatcaggctgacgttcgttctgctctttccggaaaggtatccgggaagaaaagtctgaacgtctacagagctctttccgcatatgatcccgacgccttcgaaccggacgtaacggagccggttatt

SEQ ID NO: 1899 - DNA, 1155 bp, Unknown
  Description of Unknown: Clostridiales sequence
atgaataaaaaggattttttatcggcaatgggcgatatagatgatcggtttattgaagaagcggaaaattattcccgttccgacgcaaaaaaatggctgaaatacggtggtttggcggcctgcctgttgatctgcgcgctttgtttttctctcttcggaggaaaacctgagtcaaataaggaaacaaacagagaaaaagtgaccgtttcggatctgcccgtattgaccattgaacgccggtacgtcagtaacgatacgagagagaggagagtcagcgcagcttcgggcttggaggatggcaatccctggtcagaggatgtggagatcgatacgttgccggtttatgagaatacgacttttgatcaaaacgatacgccggcatcggtcagcgacggagaactggagacatacatcaacgatattgcagagagcacggaaatgaatgtggaaagcatccgctattcgcgaaagaaggaagagaagaatctggataaatcctttaaagctgaagcggagactgccgaagggacgatcactgtctacagcagtcaccttgccattgtggaatacagtgaaagtctgacgctgcctgaggaataccgagttcccacatccgttatgacgaaagaacaggcgcagaaagtgaccgattacctccttgaggagtacggagaggtcatgggatttgaaaatgcaaagggcaccgtacaggtagaatatgacgagcaggataacgccagatggtacctcatgggatatgagagcgctgaagatcagaaggaagaagttctcaactacaacctgaagcggataaattttgttctcaatcaggagggcgatctggaggcgattgtcatggtcgacaatatggcctgcggaagggaaatcgaagagtatccgctgattacaacggaaaaagcggaagaaatgctgagggagaattatgaagggaagatcacggaagagagccagattgaaaatattcggctgatttacctggccggcgaggagtacagcctttttctgccttattatgcctttgatgtccgcgcttccgaaggtggcgatagcggagaaggtaatctggtgaattacgagacttactacgtgttggccattcccgagcagtatgtggttgaattgccaaagaactga

SEQ ID NO: 1900 - DNA, 1392 bp, Unknown
  Description of Unknown: Clostridiales sequence
atgaaaaacgtaatcatcatctatcgcaacagtgacaacaaaaatgccattcaatttatcaacagtgatctggaagagatcttcggagagtatatatcttttaccaactactacctctgcgacgccaaagacggagagatcctgaaagccgacgcattccttgttctggacgaaaacagtttcgaaagcgccaaagaaagagtagacgatttttccaaaatcatcaaactgaaccgaagtccggacagcagcgctctgcagaagatcgccaggattcctccggggagcagcgtcctcgtagttaacgactcttatgaaacctctctgagcacgatctattctttctacgaggtgggaatcggccacatcaacatgacgccgtacgacagctcgctgcgccatacgggaatatacgacaagtttgagatcgccatcaccccggcggaagcccatctggttcccgagcacatcaaagaagtcatcgacataggctaccgaagagtcagcttcgataccatgtttaagttgatgaagctgttggatctggacatcagtgtgatcaaccgaaacctgttccgtcacatccactccgtagtggaatccaacactgctttccacgccaactatgtctacggctatctgaagagcgaaatgctcagtcacgtggtcaacaagagtaagatcggcatgattctggtagacagcaactatcagaccgtctacgccaacgataaggcttcggtcatctttcagaccgatgacaaaaacgatatagatattcgcaattacatcgatccggccattttgaacagcagcgacagcatagactttcccatcgaaattctggattccacttactactatgaccgtttcccgatcaaactgatggatgaaatcgcaggttactacatcactcttcaggatgagtcggatatctccgtctccaacaaactgatacggcaaaagggatatttcgccaagcaccagttcaaggacatcatccaccgttccgccgatatggaaaaggtcatcaatacggcaaagcagatcgctctgaccgactataccgtgctgatccgcggagaaagcggaacaggaaaagaactgatggcccagtccatacacaacgcttcttatcggaaaaatatgccttttatcgctataaactgcgccgctcttcccgacaacctgctcgaaagcgagctgttcggctacgaaccgggagcctttaccggcgcgcacaacaagggcaaggtgggactcttcgaacaggctaatcacggctccatttttctcgatgagatcggcgatatttcgcccaaactccaatcccgtctgctccgtacgattcaggaaaaacagatcatgcgcatcggcagcgaccgggtcatc

SEQ ID NO: 1901 - DNA, 4032 bp, Bifidobacterium longum
atgagcacgttcactcccagtgcggaacaggccgccatcatcgatgcgccagtcgatgctgacgtattggtggttgccggtgccggttccggcaaaacctttacgatgacccaacgcatcatcgcgcttatcaatcgaggtgtggcacctgaacgcatcctgggcctgaccttcacacgcaaggccgcaggcgaactgctggaacgcgtctccgccgcagtggccggtgatatggcgggctctacgaccgccacggtgtctgatcgggcattcctcaagccggccattttcacgtatgacgccttcttccagaccatcgtgcgccaatatggactgcttgtcggattcgatcagaacacgcaaccattgagcgcagccggagcgcttcaactggccaccgaagtcatcgacagtcacatggatctggcgttcagtgaggattttggcgccttctccagtttggcgaaccgtgttctggcgttgtcggatgccattggcagtgccatgatcggtgccggctgcaccagcttcgatgatgcgatcaatcgagtacggcaatgggattcggcattcatcaatcgattgcaacaagccgttgcagacgaacccatgcccgaggacgagccgaaaatccccaagatcaaacgactgaagaaagataccgacgccagctggcaagccaagctcgatgaccgtgccgaacatttgcacgcccgctgcacctatcattgcggtgcgctgctggagaccacacgcaaacgcgatattctgctccagctggtggaggcctatgcccaagccaagcgggaacgcaatatggccgaattctccgacttcaccattgccgcgtatcagcttatcgagcgcttcccctccatcggagagcgtacgcgccgcaggtacagccacgtgctgctcgacgaatatcaggacacctccaccacgcaggccgctctgctggcagcactgttccacgtggatgcgtcacagaggtccgccgtcaacgcggtgggtgatccgttccagtcgatttacgcatggcgtggtgccagccctggtgcattccgtatgttccagcaagatttccacctgtctgccggatacaagccattcccgctgtccgtcaccaggcgaaacagccgtatagtgctcgaagccgccaataatctcacgctgccgttgcgctccaatccgtcgcgtccttccagctcattgatgcgtgaggtcgatgtctcatcgctcgaccccatgcctgatgcccccgaaggaacattgggagtactgggcttcgccacggccgggcaggagatcgacgccgtagtgcgtttctgcaagacggccatcgcacggcaccgttccgcagccgaacaacaggaacagatgccgggcgaacagaaagcgccggtcgccgtgctgtttcggtccaaatcacatatgcccgaatatcaggcggcattggaacaggccggattgaccacattcgtggtcggctattccgcgctgttggaacgtccggaaatccgcgatctgatggcgttgctgcacgtggccgccgaccacaccgatacgggatcgctgatgcgcttgctggccacgccacgattcaccatgtccgcagcggatttgaccatgttggcccgttttgctgaagaacagaacacggaacaacgcttccaagcattggtgcaggccggccttgcccaaccggatacaccagcgaatgaatgggcggctgtggtgcgtgagtaccgcgatcaggtggccaatgcggtattcctgccagacgtattgctacgcggcgacctggtaaaactgcttgaacggttgagcgcacacgggcgcaacgccataacccgggccgcggtgatgctccgtcaggtgcatgatgccgtcgggcggccactgggcgacgtgattcgcgccggcatagaagcgttggatcttgacatcgacaccgtattggccggtgtgctgcataatccgcagcaccgcgccaatcccgctttggcgcatatgcctatggatgcgattgtggatttggtggatacgtacacgcaagagattgccgctgagcaaactccctcgttgcatgggttcatcacatgggtggatcatctggcttcggtggaggatgaagccgccagtctccctgacgctccggtggatgtggaactgatgaccgtacaccagtccaaagggttggaatgggatgccgttgcggtagtggggcttaccgccgtcggattccccagcaatcagggcgaccatctcaagatcgtgctggacgagcaccatacgggaggcaccgagcaaggtcactggaccgcacccgaatatcatgagaccgccgactcctggctcaccaaccccaccgccgtacccgtgcctatgcgtgccgatgccggcattctgccgcgattcccccatgatgccgatgtggaagccgaccccatcgcatcgttggcggctttggatgatgtggagcttattgatgatgaagtgttcggctccatgcgcgaattcggcgatggcgtggaagaagtggatgcatccggctggtatttgacgcaggcggaggaatatgggcgccggctgcatgccgacgaacgtcgattgatgtatgtggcgcttacccgtgcgcgagaagatgccctgatgacctattgcgcctatacgggcgaatccgggcgggacccgtcagtggtgcccaaaggctctcgcgccgctcagccatccaatttctggcttgaagtgcatgacgcgctccaagcccgtgaacatgcgatatcggctcaggactgtgtggaacggctgcaagccgccaatgccgggaagcccatgctgatctcggcgcaaggcgaagcgattgccactcccgaagggttctttatcggagagcatgccgcggcatacggtgacgccgtggtgggggaggcatggcagacgccgattacgcagacggatgccgctgtcgaattgccgtggccggctaccctcagcgacgcagtgcatgaacagctgtcacgtggcatcgatgttatcgccgcagattcctcgtcacttgagcagcaccaagacgccggtccactgctgcaacgggcgcaattgctggtggacgacgccgatttgatggccgatgccgccagcggccagtcgcttgatgaggcagtcaaagccaaggcgcaacgcgttctgactgcaggacgccagaacgtgacaagcctgcaagcccgcgtaggtggcatgaacgaacgggaggagcgcctctactggcgtagcattatccgcccgattccgcgcatatcgtctccggcggccgaggccggcacgcagttccatgcgtgggctgagcaattcatcaatgccggtaagccggatgaagcggtactggcatatgaagccgaatcaagtatgccgcatacaggtcaggatgcgggattcgtttcccgggaagccatgttggccgatttggccgaacgggagcggcaatgccgcaagccatccacacggcagcccgctgtcccacagcccacggctcaacaatccgcatccgccgtatccgccgcctccgccacttccataagtagcgacaatgccaccgagtccaagctggtggcgtggcagcgcagactggccgaatcatcgtgggccaagcgcatcccggcgtggacggagcgtgccattgtcgtggacgtgccgggcgtgggcctggtcaatggcaaactcgatgcggtattcatcggtggacttgacccgtccagcaccaccgcacgctttaccgtggtcgactggaaaaccggtcgtcggcccaccaagccagacgacatcacccgcaaacttgcccagctcgacatgtaccgactgctgctggcagcggtcgaaggtgtggaattggacagtatcgacgccactctctactatgtcagtgagcccgacgagggcttgcgcgagcttcgcgcccgtgcgaaaaccaaacaggaaatccttaccgagttgagctccggcattcccgaacaatctgacaacgactga

SEQ ID NO: 1902 - DNA, 2310 bp, Bifidobacterium longum
gtggctctacgccaggaagaagaacaggcaggcaaacgagtgaacctacccggagtcttacgacattgcacacgtctggcacacgcactggcggctggcgtcgccgttgtggcgatgctggccgctccattgaccgtctacgcgaacgatacgacggacacgactgattcatccgatacgacggacgcaacgggcaatcagaccgagaatcagcccaagcagagcattgccatcacgcaaagcacccccatcgtcacctccaaatcgggctatcgtgtcaccgcggtcatcagcaatacggacagcacggccacgtcaagcggcacactgcacctgaccaccaatgcgttgttcacctttgtctcgcgcaccgatattcagaattgggccgagaacaacgcccccatcccaacccccaacgagttgggttccgttgacgtgccatcgattcccgccggcggcactgccaccgtcaccatcgaggtgaacgccaatcagcagacccttgcctccatagggagttggggaccgaaaccgctgatgctgtcgtatatcgttggcaatcagatactcgccgatttgccgagttttctgacccgatcttcggatgggctcaacaccgcgacaacaccggccatgaacctgaccgtggccatgccctacaccgccagcggctggcaggtcgataataaggccatcagcaatcgcattgccgaaaccaccacttcctcgacatcaacatcgtccaagtccaacagcacggacaaggccgacaagtccgataacgccgacgccagcaacgcggccaaagccactgatacgcaagccatatccttatccgaacaggatgccgataccgcgcgatcccttgggcagacattcgccaagcaccgctcgctgcaagtgatcgcggatcctctgtattggcgtcagtccgcagtgcaaccgtccattgccggcatcatgcagcccgccgacttcgacatcaccgcctataccgcactggacgataccgcggcctacgaaaaggccggcatcaccactgagcagtggaacgccaagcaggcggccgcatggtatgccgacggaggcgactccgaaacaccctccgcgtacgcatggcagggcaacaactgttggacgttggatgcgctgaccgcagcacgcgagcagggctatgacacggtgattgccgatgcctctttcgatgccgaccagactgaagccgtacacacaggcacctacgtggtgcatacgcctgccggcgatgtcaccgtgctgaaggagcaatcgaccttgggcacgctggccaagggccaagccaccagcacggacgcgcaggccgagtccagcgatgccggtcggttggcccgactgatcgctcagagcgcgttctaccagatggaacagccctatacatcccgatacctgcttatgacgttctcccgcaccacggaggccagctggatcgatcaggtgatgagcgccttcgagcaggcgtcttggttgaatctgacggacctgaagaccatggccaaggccgatccgtacaatgtcagcgattcggtcaatcccgacaaggccgatgatgccaacaccgccaatacccggtcggcattgagacagttggccgacagccggcatgacatcatgcgcatggccacctccatattgaggaacgagattgattccgacgaggtctcgtcgttggacccgcaggccctggcccggcaggacgccaatgacaccgcctcgcatagcaacgatccgacgcaatggattggctctttactggtgctgcatgacgatatggcgctgcggtccatgtctggctccccccagccgacagccacgcgaaaagccatggtcaaagccgcgaaaacactggccagcgatcttctgaacggcgtacgcatcaacccatcggaatcggtatccgtgttcagcgaatccgcgaaaatgccaatcaccgtcagcaatgaccttccctacgccgtcagcgtgcaggtcaactcactgactgactccatgcagatcgtcacctcgcgaaccgctgacatcgatattccctcgcatagcgacgctcaggtgaccttcaccatccgcgtttccacttccggctcatcgacggcccatgtgtcgttgaccgaccgggaaggcaacagcttcggcaacacgcaggacaccgcgatcaccagtgtgatgcgcatcagtgatgccagtggcttcattatcatcggcttcgccgtgctactgggcattatcggcctgtggcggcagttccatcggaagaaggaccccgacgaatga

SEQ ID NO: 1903 - DNA, 2868 bp, Bifidobacterium longum
atgggagaggccagcgtgaccgtacccaccaatgaaacattgctggtggtggacggccactcgctggccttccgtgcatttttcgccctgccggtcgacaacttcagcacctccagcggccaggccaccaacgccgtctggggttttgccaccatgctcgcgcaggtgatcgatgcggagaagcccgaccatctgggcgtcgccttcgatgtgaagggcggcacattccgcaatgagatgcttccgcaatacaaaggcacccgtgaggcggctcccgaagagctgctcacccagctgccattgattcaacgcatgctcacggccctcggcgtcacctacatcgagaagccgggattcgaaggcgacgacgtgatcgccaccctcgccaccatgggagacaaggccggttaccacacactggtattgtccggtgaccgagacgctttccagctggtggatgacaacgtcaccgtgttgtacccgggccatcacttcaaagacctgaagcatatgacgccgcagtccatcatcgacaaatacaaagtcactcccgcacaatatccggatctggcggcactccgaggcgaaaccgccgacaatattcccggtgtgcccggcgtaggcgacggctttgcggccaagtggatcaaccaattcggttccctcgacggcatttgcgagcacgccgatgaaatcggcggcaaaaaaggcgaatcactgcgggccaatatcgaccaggtcaaactcaatcgcaaagtcaacgcactggtacgagacgtcgatctaggcgtcgatatcgaggatctgacattcggcaccgtggacgtggcacagatcgacgccctgttcaaggagcttgaattcggacctcgcaccaagagtcgtgtactgaaaaccttcaataccggggccaaggcatccaacacatccggagctggcgagtctacgaataatgagcagaacgagcaggatagcagcctcgatctgaacctgccggaacccacgagcatcactgctccggagcagttcgacgaatgggtcaaggcccatcgcgtcgaagtcaaggttcccggtgaaatcgccgatttcacggtttccgactatggcgatggctcgcagcggcatgccatctgcggcgacgcggtcggccacgcttggaccgtggccgcatggggcgacgaaaggccggggcgtgccacggcacaagccattgccgtggccacggcaacatcagcggccatagtgccccttccaatcaccgataccctgcgagcacagcttgcgcggttcctgaaaagcgaacactcccgcaccatcgtgcatgggtataaagaattgctgcatcttttgggcgcggtcgatcttgacatggacctgccgatgttcgacaccaagcttgccgggtatctggcccaaccggatttccatgccgatagcctcaagcaggcggccgagcacttcctcgacatccacttcaccgaaaccgaacagccttcgcaaggcacgttggacttcgacgacgatcaggtcgaagaagatccgaacgaacatcgtctgcgtgatttggccattatccgcagcctcgccgtcacgctcgggccgattatcgacgagcgtgaacaatgctggctgatgcgcgcgattgaacttcctgtttcccgcgtgctgcacggcatggagcacacaggagccaaagtcgatagcgttcgactcgtctccatgcgtgaccagtttgccgccgaggctcgccaagcgcaggaaatggcttgggagtatgccggcaccgaaatcaacctgcaaagccccaagcagctgcagaaggtgctgttcgaagatatgggtttgaaacccaccaaacgcaccaagtccggctcatacaccacgaatgcggccgcattgcaggatctgtatgtcaaatcagtggacaatgagcgggccaacggtttcctcggagcgttgctgcgccatcgcgagatcaacaagctcaagcagatcgtccaaacgctgatcgatgccaccaacacatcagatgagcgcatccacaccactttcgagcaaaccgttgccgccaccggccgattgagctccgtggatccgaacctgcagaacatccccaatcggaacgccgccggccgtgagattcgtggcgtgttcgtgccgggggaggggtacgaggccctgatgagctgcgattactcacaggtcgagctgcgcattatggctgatctgtccgatgatgaggcgctgatcgaagcgttccgctccggagccgacttccacaaatacgtggcctcgatggtctacaagctgccggtcgaccagatcaccggcgaccagcgcagccacgtaaaagccatgagctacggattggcctatggcctgagcacgtatggtcttgcccagcaactcaagatcgcgccacgtgaagcggaagcgttgaaaaaccggtatttcgataccttcggcaaggtgcacgattaccttgaatcgctggtggccaatgcccgagagaaggggtatacggaaaccattttcggacgacgtcgctacttcccggccctgcattcgaccaatcgtgttgcgcgtgaggccgccgaacgtgcggcactcaacgcaccgattcagggatccgccgccgacatcatgaagattgcgatgattcgcgccgagcagaccttggccgaggctcacgtcaagagccgtatcattctgcagattcacgatgaactggtagtggaaatcgcgccgggagaaggcgaccaggtcaccgaactggtgcgcaacgccatggaacacgccgtcgaccttgccgtgccgctggacgtatcgtgcggcatcggttccgactggcaactcgctgcacactga

SEQ ID NO: 1904 - DNA, 3096 bp, Bifidobacterium longum
atgagtccgacaggtaatagcgatattcatgaggcgttggccgacgccatgtcttctcgaccatatacgcataggcaggatgtggataccggcattacggctgtgatcaccgttgaggaggatatgcgtttcctccggtctacattgcgttcggtattgacgcagaatgttcttccgggggtcgtcatcatcgccgacgcgaccgggcgcaccagttcgaggataaccacctcgttcgaggtcatcccctcgccatcggggccggtgatggaggtgccgcagtccaagcatgtgaccattcacatcgtctcggccaagggcgcacgctccttcggcgatgcggtcagccgggcattggatcgtgccgatctggatgacgctccccgcgcattgtggctgctccatgatgattcccgcccttcggatgactcatgccttgaacgattgcttgaggcgtggcgcaatacgccgggcgccagtgtgctcgggtgcaaacagtgcgattgggaaggctcccatctgcatgatgtcggtatgtatgcgggtcaccacgccgtgcattccctggtggtcgatggagaacccgatcaggagcagtatgacgggcggcaggatgtgtttgcggtgtcgctggcaggcgcgctggtgtccatgtcgcaattcacgcgactgcggggcatcaatgcctggctgaccacctacagcgaatcggttgatttctgccgccgtgtctgcctgagcggcggacgcgtggtggttgtcccgcaagcggagatatcacatcgtcgcgcacggtatgagggcattcgtacgcgaggcggggaaccgcttaaggacgatcacacggtcaatcatgcgatgacggtgcatcgctcccaacagcggtatctgtacacggacctggccatgtcgtcctggtttatcgtctggctgtggaggctgctccgcagttttggcatggccatatccatgatgttcggcaagaagccgtatgaagcatgggtgcaattgtgcctgccatggctggccttggccgatatcgcgggaaacatgaaatcacgcagtctggtggccagacaatcgaaggtcgccgcatcgtccctgcatatcttgttcgcagacagccagcagatcaagcagttccatgatcgtcgggatgcattccaatcccagcagggcagagtgctgctcagtccgctggaacgtgcccatctgcggacacgcaccatatatcgctggagtgcggccgtggtgatggcgctggtgtgctttgcggccatcgcggtgatgtattggccggtgttccgttcgatattctccggcggatcgttgtattccgatgtgttgcttcccaccggtgccagcttcacgcaactggtgcagtccgccaccacgccgtgggtgtttggcagcggcaccggcattcctgcgccgcccacgccgtggctgctggtgctgatgctggcctcgttggtcacgctcggccatgtgaccgccgctttggcgatgatactgtttgtggccgcgccgctgagcgcattgtcgttctgggcgctggcgggcgtattcacccgctcggacgtggttcgtgtgctgggaggactgctgtgggcatccaccggcattatgttcggctggtatgcgcaggccaatatgccgatgcttaccgtaatggtgttcctgccggccgcgttcgcattcgtgttccgtgccgtgggcatgtaccataccgaagacccgctcaagccgcgcgcatccgttcaggccgcggccatcgccgcactgtgcttcatccctgtggtggccgctgaaccgcagctgctgttcgcgctgatcgtcgtgttcctgatgttcctgctattcgtgcgtcgcaagcgcgccatgctgttgctaattccggttcctgccgcctttgcggtggctcctacgctcgtcaatgcggtgcgttacgccgatttgggcatgtggcgtcaactgttcggcgacatcacggtgccaacgtcatccgccaacgggtcgccggcgtcgctgagtctgcttgaggccgcacagcgtgcgctgggatggcgaatggggtcgactgattatgccgatttggcggtcactgtgctgtttggcgtcatcacgctgcttgctcttgcttcgctggtgctgccgttcgcgttgcggacctcgcgactgatgtgggtggtaatcgtctgcggaggcgcgctcgccctggtctccagccgtgtggccataaccgtggatgccgatggtgtcgtggccggttccgcgcagccgggcatcgcgatgatgatattgggcttcctcgcctgcgtgtgtctcgtcgctggtggggcggtgaagcgattccaaccgttgcatgcgtctggcagtgatcccgcatcgaaaaaggaccgtctgcatgtgctcatcgtgtctggccgtgtggtgcttgctctgatactggtgtgctgcattggcatccaatgcatgtatggcatcgaacgtcataaggatgcgggactgggcgtgtctgaaaacggcctgcccatggtcaccaccgattatctggaggccggtgccgatcatcgtgtgcttgccgtgagcgcggagacccgcaacatcgtcaactatgcggtgatgcgcacctcgcgcggcgatttgatcgacagctctccggtccagcgggcgcgcctgctgtccggcaagcatgatgcggttgacgaacaactggcccaggcctgtgcctcgctgctgtccaatcccgacgaagaggccatcgcggccatcagcgcgcttggattcggcggcatctacgtggttcccgagaccggcgattccttgaacgacatgccgtatgaacagttgagcgcgaatatcgccgcatcgaacggcacccagtccctggtctccacggatagcggcagctactatcgtctgacgctgcgtagcagcgcctcacagcaggtggatacctcatggcagcaacgtgcacagcatagtgtctggaggcacgcctggctgatatgcctaggtgtgatcacggcgttgtactgcttggtcgccatgcctcgcagacgaccgtcctacggattggaggagcaggcatga

SEQ ID NO: 1905 - DNA, 2631 bp, Bifidobacterium longum
gtgggcaatatcttcaaggtcctcagacgcgacttcctgcgcctgttcaaggtgccggccgcatgggtgatcctgttcggcatggtgttcatcccgccactgtattcgtggtacaacatcgtcggcttctgggacccgtacggcaataccaaaggcatcaccgtcgccatcgccaacaatgacgacggcaccgacaacgcgctcatcggcaagcagaacctcggcgatcaaatcgtcaagcagatgagaagcaacgaccagctcggctggaccttcgtcaccgaagccgaggccatggaccaagtggaatccggcaaggcatacgcagccatcatcattcccaaagacttttccgacgatctcgccggcgtggtgaccggcggcaagagtcggcccactctggagtattacgtcaacgaaaaagccagcgccatcgcccccaaagtcaccgacgtcggcgcgtccactgtggaccgcacggtcaattccacattcgtctccaccgtatccgaagtacttaccgaagtcatcaatacggttgacggcaaagccatcagtaccgaagacaccaccaaagccaaggccctcacggcccttgccaaggcctccgacgatgtgcagcacacacgcagcaccatcgccaagctcaccaccaaactcaccgacaccccagagcagacacgcaccgcacgtcaggcgctggacgacgcgcgcacacttggcatcgacactgcagaaggtctggccggcgtctccaccctgatcggcactacccagaccagtctgaacggcttcgtcacctccacgtccgaagcgcttgaccaaggctcaagcctgctgagccaagccgcagcacaggccaaccaaagcgtgggcacggtaaccggaaccatcagcgccgccaatcagcaggtaggcggactgatcaatacggcggaagacatcaaccaagcgaacgccgacatcatcgaccaactcaaagggctgccgaacgccaatcgagaaccgctgcaatccgccattgccacactggaaagccgcaatagcgagcttgccggcgcactgggcaacctcgatagcctgaacaccactatcggcaatgcctccacagacaccgccggattggcgcagcatctcaataccgccacccaaaccacggtgcgcgaggccaataccgctcgcggcaccatcacctccggcgccattcctcagctcaacaccggtctcaacgccctcagctcgaccgccagcactctgtcgaccggcatcacgtcgcaaggctcactcatcgatcagtcgaagcataccctcgaccaactcgacaaagcagcctccaccacggtgaccgcgctgcgcgacaccgataaggcgctggccggcgtacaaaccaagctcgatacgctggtcaccgacatcaaagccctgagcatctccagttcactcagttccctgatcggcaccgacggcaaactggatgccgcctcaatcgccgacttcatgctctcccccactgttatcagcgaacaggccgtctatccggtcgcctcctatggttccggcatggcaccgctgttcaccaccctgtctttgtgggtgggcgcgttcgtgctcgtggtcattcccaaactcgaaaccgatgatgagggcatcgacgatctcacaccaacccaaggctatctcggtcgcttcctgctactggccacgctggctgccgtccaaggcctggtcacggccatcggcaatcttgtcatcggcattcaatgcgcgagcgccccagtgtttctgctcacctgcgtcatcacctcactggtgtatatgtcggtgattttcgccctctccaccacgttcatgcacgtgggcaaaggcgtatgcgtggcgctggtcattctgcaggtgccgggcgcctccggcctgtacccgattgaaatgatgcccgcgttcttccgcgccatctacccgctgctgccgttcacctattcgattgacgcgatgcgtgaaaccatcggcggcttctacgacggcctctggttcgcctatatcggcaaattgctggttttcgtggttctggcctttgcgcttggcctcggcgcccggccgaaactggccaatctcaaccgcctgttcgcgcgggaaatcaaggaaagcgacatgattatcggcgagccggtgcatctgcccggcagcgaataccgtgtcactcaggccattgcagcactggccgaccacgacgaataccgtcatgccatcgaacgtcgggccgccaaattcgactaccgttatccccggctgctgctgggtgcgcttattgccggattcgtggtgccggccgcgctcattatcgtgtttgcgctgaccaccagcgagaaaatcgtagtcatgggcacatggctggcatgggtgctcatcatcatgggcttcctgatggtcgtggaattcatgcgcgattccatccgccgccaaaccgagctcggcagcctctccgacgagtcgatccgcgccatgctgtacgggcataaggccaagcgtcgcgacacctccgccgaacgccacgaagaagcggacccgagcgccgctgttaccgcaatcatccccactattccgccgaccaaggaaggcaggcacgcacgatga

SEQ ID NO: 1906 - DNA, 3837 bp, Bifidobacterium longum
atgaagataaacaataagggcaagggcgctcttatcgcggcaattaccgccgcggcaacgctattgtcatgcgggctggccgctgcaagtgccagtgcggcaggtgtggattacctgcctgccatcggccaagtgccgacatacaccaagttccagcccacagccgatccgggcaagaacgctagcgattacttccagccatattggtatgccaagaacgccaatgataatggcggcacacacatccaagcgcacggtggccaagtggtcaaggttggcgacgcctactactggtatggcgaagaccgttctaacggttacgacaacagccccggtgttcatgcttatatgtcgacagatctatacaactggaccgatcttggtgtggcgctgcgtgcggtgaccagcaaatctcagttgacggataagagcaatgccgattacgcctacttcgacaaggcctacaacctgaccaagtccgacggcagtgtggacgctgccaaggccgacgcaatcttcccgtacctcaacaccaaccccgatcaggatggtgatggcgcggttgattccgtacagggcattttcgagcgtccgaagatcatctacaacaagaagaacaagcaatacgtgctgtggtggcattccgatggaagcaccacgccgggcggttccaactatgcacgtgcacttgcgggcgtggctgtttccgacaatccggcgggcccgttcactatggtgggtgcctatcgtttgcctaaccagaacaattggaaagaagccgcaggtaaccccagctggggtgagaacggtgacagccgcgatatgactgtgttcgtggatccgaaggacgacagtgcctatgtactgtattcttccgaagccaatgccacgctgtatatcgccaagcttaacgatgattacaccaatgtagtcaagaccacgaatgtggaccagtccgagggacaaaagcagtactctgctgacgggcagtacccatacattcttgcagacggtactacggatgccccggtgcgtggcgaagatttccaaatcgtcaaacaaaatggttcgctggaagctcctgccgtattccaatatgacgggcgttacaacatcatcgcatctggtgcaaccggctgggacccgaacaagcagacctactacaccgccgactccatgctgggaagctggacccgtggcgtggaaaaggacgatgccaacgagaacacgtggtacaacaacatgccggaaggcgcggatggtctgttgtctgtgggcgatacccgcggcaccacattcggttcgcagtcggctagtgtgctcgcagtagaccaggagaaaggtcacttcatctaccttggtgaccgttgggattccggtaaagccgattccacctatgtttggctgccgctgaccatcggtgagaacggcaccatcgaaatgcataatcctgctcaagaaggcgagcccgacggctgggatctgaactattgggacaaccatggtagcgccaagggcaagctggtcaactggactgtggaaaccggcgatgatctcccgaagaccgtgaacacgggcggaaccgttactctgccggacaccgtcaacgtcaaggaaggcgacgataccattgctaccaaggtgacatggaatgtggaaggcggtacggcagtcagcaagtcgaccaaggctgccggcagcacctacgcattcaatgtgccgggaacctacaccattacgggcactcttgccgagagcagcaacttcaacccgggccgcacattccgcagaaccatcgacgtttcctgctccaacccgatttccggaagttggaaggaagcccattggaagggcggcagcgcgtgccaggtcgccgcatccggcggtacctatgacttcaccgttacggacaacgccaatcgtggtgtctggacggatcgcaacgagggcagcgcggtgtaccagcctgatgctctggacgtgaacgaaacgttggaaaccacggtcaagccgctcgacttgggcggtaatggcgatccgcgtgccggcctggtggttcgtaacggtcttgctgacgctaacggcggcaagggatatgccacgttacttgccagcccaagcggcgtttacatgcagtacgattccaatgccgatggctacatcgataaggaaacatcgcatgttggtgccggcttcggcgaccaagtgcaactcaagctggagcgcgccgcaaccgataccctgaaaggctactggcgtgcttccgcgaacgatgaatggcaggatgtcgctacggtaacgctgaccggtgcggacgcaaccgggctcgatgccggtgtcttcgccacgtcgaacagcaatgccggcgcattcaccgtggccttcaacggcactgcgttcggttcgcagactgctgctgtggagtccatcgcggctaaggaccctgaagccactatcgccaaggggcagatgctcgcgcttcgggacgtgacggttaccgccacgctcaccaatggcaaaacgcgtgtgctggagccaagcgaatacacgctggaaggcttcgacaccaccaaattgggcgagcaaaccgtgacggtgcgtcttgtcgctgattcttcagtaactgccacgctcaccgtgactgtggaaagcaaccttgcccggttgttctgctcgtccgctgcggcctcgaagtatgagccggccagtagctgggcctccgcttctacggccgacctgacttgcgacaacaatctgagcaccaactggtcgaactggggcaccggcgacacctcgccgtggctcagctacaccttcgataaggcatatcagctgggcaagctcagcgttgcggtggataaggccaagggcgaggccgctccgaagagcttcactgtatcgtacctagctgaagacaacgccacgtggactgatgccacgctgccggcagtcactgtgaatggtgctgctggagccgtgacggaagccgatgtgagcgctctgcccgccaccaagggcattcgcctcaacttcacctacgccgatggcaatgactatgccaagatcgctgaagtacgcatcgccgaaggtgaagcgacaccagagccgcagccgtctagtaacgccaatcttgctgatctgactgtggatggcaagacggttgacggattctccgcggatatcaccgaatatgccggtgcgctggccggagacgctgcttcttacccgacggtggaggcgactgctgctgacgcgaaggctacggtgcaggtggagcaggcttcgaccgagaacagcggcgtggccacggtgactgtaactgctgaggatggcacggcggaaacctacacagtgacattcggcgaactgcctcagttggccgagcttgctgtggaagtgaccaaggattcctatcaggtaggcgataagttcaacgctgccgatgtgaaggtatccgccatttacaaagtcggcgataccgaaacgctgcgcaagctgattgatccaactgatggtgatctgaagttcactggctttgattctgccaccgcaggcacgaagaccatcaccgtctcttatcgtggcgtgaacgcgacgttcgaagtcacggtcacggccacggaggtcactcccggccctggagagcagaagcccggcgataccaacaatcctggcaacactgctaagcccggtaacactgccacgaataagccggctgctaatggcgctgcgcccctttcgaatacgggtgttgccgtggctgccattgcggtcgtggttgtggtgctgacagctgcggctggtgccttgctcgtcatccgcaaacgccgcgcataa

SEQ ID NO: 1907 - DNA, 2340 bp, Bifidobacterium longum
atgaagcttatctggaaaatattcgtacgtgacgtgcgccaagccacccgcaatgtgatcgccgtaatcgtggctatgggattggcgattgtgccggcactgtacgcctggtacaacatcgccgccagctgggacccgtacggcaacaccaaggccttgaaggtcgctgtggcaaacgtggataagggctataagtccgatctgatgccgatcaccatcaacgtcggcgaaaccgtgaccaatacgctcagggccaatcatgaccttgactggcagtttgtggatcgtgctaaggccatcgatggcgtgaactcaggcgaatactatgccgcactgattattccaaagagcttcagctccgatatgatgacgctgttttcaccgaagatcaagcacgccaagctcgaatactatctcaatgagaaaatcaatccgatcgctccgcatatcaccgaccagggtgctaccaccgtggccacgaccatcgaccagacattcgtgaagaccttggcgagcgtggcgctggatttggtttccaacgtggccgattacgcgcaaagcccgcaaatggagcagtacgtcaacaacgcctccagtcatattgccaccatgtcgtctcgtttgaccggcactgcgtcgcagatggattcctatgccaatctgctcggggccgccaacagcatcattgattccaccgataagctgctggggtcaacaggctcagctgcggccacaaccaaaaaggcgttgaaacagacccgcaacggcgtctccagcctcgacaaggcattgtccggagccaccgatggcgtcggtacggcattgcagcaggccggttcatcctacgacaccattgccaagcaaatcgatgccgcttttgccgatgtgggctcacaatcctcacagatatcaaacaagctaaccgatatgcaatccaaagtggaggctcaggccgacagctttggaaagtatgccgccgctttacgagatctcgccaaacaagcggcttcactgcccgtgggcggagataccgttgccgctcaactgaacgcggctgcagaccaagccacaaaggcgcagcagagcatgcagcaagccgccaccgcgttgggcgatgcggccacgcacatagcaaacggtactgccgatgccgatacagcgcgtcgagatctgaaatcacaaatcgctgccgccaaacaatcgattactcaggcttcagacacgtacaagagcacgctgaaaccgcaactgaacaatctgacctcgtccatggacgaagtgaccacgcaggcaagttccgtaatcgacgggcttgcatcgaccgtaagcagcgtgtcaggtctttctggcggcgtttcagacagcctgacggacatccagtcggccttgactgacgcagctagcgctttgacccgttcggcgaagaaactcgacaacttgtcttcccaactcgcctctatcaccaatggcggcaccatcgacctgtctgtgatttcctctgcgaagcccgatgccattgcttccatgctggcggcacccgtagcggtcgaccgcatcgcgctctatcccgttgccaactatggttccgcgatggctccgttctacacgattctgtctatttgggtcggtgcgatcattctggtcgccatgttgaaagtatcgatttccgaccatgagaaggctcgtatcttagggttgggcaatgatctgccgctcggttcggaagtgggtcttcgcgaggccatgattgccgggcggattgccggaccggccgccgcgttggatgtgctgaagaagccgcgtgccgaggctcccggcaatgcgcggcagttcggtttacgcttgcaccacgaatatttcggccgatacatgattttcggtttccttgctttgctgcaaggtacgctggtgtgcctgggcgatatgttctatctcggcgtgcagtgtgagcatccgattcagttcttgatggtcgggtggttgtctgcactggtgttctcgaatattgtgtatacgctgaccctgtcgttcggtgatatcggcaaagccattgccgtagtactgctggttatgcaggtagccggttccggcggcacattccccattgaaacactgccgacgttcttccaggtcgtttctaaatggctactgttcccctatgcggtggatgcgatgcattcggccatggcaggctcattcggcatggaatactgggtttccatgggcaaactggcactgttccttgtcccctcattgctgttgggacttatgttgcgcaagccggtaattcgcttcaacgattgggttatccgcaaccttgaaaacaccaaggtgatgtaa

SEQ ID NO: 1908 - DNA, 3624 bp, Bifidobacterium longum
atgacccagagccagactcagaaccagaatctcacggaaggtctgaatcgcatccgtcgctggcgtgaccaataccgcagcatgcagccgccatcgccgctcgaggatgtgaatcaactggccgcgaagctggagatgacccatgcccatccctccggcatcgcccagctgttcgcttccggccatgtccggttggattcgttgttccgcgacacgggtgtgcttaaggccgccgaacgccatattgggcgcgtgctggatgaccaggccgccaaacgcaggatttccggcgtggcggagttgtcgctcgtggtcggcgtggccacatggaagggcaacgcgctgccggtgctgttgtacccggtgagcgtcacgatcgaggatgatggcttgtcgaccaccattcgattcaccggtcgcgtgaccctgaacgtcgcgttcgtcaatacattgcgtgagcagggggtgttcctggatgaggattccctgtttgacggtgccagctatgacagtggcactcccgaaacttccgcgatgttcgcccgtatttcgtccgaagcgtcggagcgtatctccgacttcgccatcgagcgccagattgtgctcggatgcttcatggacccctcgtcgcagatgatcagcgaaagccgacagttcatcgaccagctggagaacggccccaccggcaatgtgctgttggacgcgcttgccggcgacgaatccgcccgcaccgcgctcaaagatgccaatattccgcaatacagtcctttcgacgtagacccgcatgccgagtacgaagtcggcgatgtggacaatacggtgcgatatgccgcgtcacttgccgccaatggccatagcatcgtggtcgacggcaccttcccgaagggcaccgcggagcaggctgtggccatcgcatcgcgctgcctgatgaatggtcgttccgtgctgtacgtgcccggcgtggccgagcagaagcgtctgttcatccagacggcctccgccaatgagatgaaggcgcaggtactggatgtatccgatgaacacgccaacgccgcgcttgataagcagctgattgccgcagtcggattccaaccgggagtcgccacccagcgattcgaccagttggccgacgaactcgtgggcgtgcgttcgcgcttgacccgctacttgggcgacctgcacgggggcaatgataagtggaatgtgtccgcatacgagaccattcagaatctggcccgtatctccgtgctcccgacgcaccctgccacccacgttcgacttgacgagtcaagtgccctgagcatcgccaacgatattgacacatggatcggcaagatggaacgcgccggcgagctcggcgaatacaccatcggcccggaagacaccgcatggtacaaggcgtccatcaccactgaagaacaggcagtaaccgcctaccagcgcgtggacgatttgctgcgtcgcttcctgcccgccacccgtgagcaggtggcacgcaccgtgcagacctgcggattcccggttcctcccaccacccgcgagtgggagcgtcaggttacggttttgaagaatctgcgacgagtgcttgacgtgttccagccggagattttcgagcgagacatcagctccatgatcgaggccaccaagccgaagagccagcgcaaggccgagggcacgtcgatgggattctgggagcgccgccgccacatcaaggaagccaaggatctgctgcgcgtcggcgcgcaggtcgaggacttgcacgaagcgttgaaggtagtcgccaagcaaggggagcagtggcatcagttcgtgcctcacggcggttggccggtgctgcccagcaagctcgacgagatcatctccacccaagaggcgctggtcagcaatatgaccgcgctggataccgtgctttccaccacacccgctggtggcaatctggaaaccgccgatttcgagaaggtggaagcacgcctgaaagcactgctggatgatcgcaaggcactggacaccttgccggagcgttgcctgctggagcaggaattcgcctctgccggactgaacgaactggtcgccgatctcaacgctcgccgagtgagcgtggagcaggtgcgcggcgaagtgcagctggcctggtggaccaccgtgtttgaggacattgtgcgttcgtccgccatcatctccaaccaggatggtgccgcgctgcaggccgcatccgaccgctttgcgcaggtcgatgtggagcacgtgcgctccatcggaccgatggtgtcgcaggaatccatgcgccgcctgtgcgacatgctgttctcccgcactcaggaagccaaccagatgcacaccgtgctggcagggcgcgccagtgtgtcgctgagcaggattcgccgtgatcatccggagattctggccgcggccaagccgattctggtggccgcgccgggtacgctcgccgcactcaccgagccgggtgtgctggctgatgtggcgattctcgatgcgtgcgcgcacattcccgctatcgagttgctgtccatcatcggccgcgtgcagcaggtggtggtgatcgcccactgcgcgacggtaaccagcgaaagcgtcaagcagctgatcgacacgttgcctcatatcgaggtggatgctgccccgtctcgccgtgcgccgcgcctgtccgcattccttgaatccgagggatatggtcctgttcgctatgatgtggccaccgagccggctgccggtgaggtgcgattccaccgtgtggaagcgagcggtgtgccggttatgtcttctggtctggtggaatccagccagccggagattgatgaagtggtgcgtctgattacgcaacgtgccgccggttttgccgtggttccttccagctatcgacttgtggtcgtgatgttgaccgacgcattccgcacacgcttgggtgccgaattgaagtcgttggcaggcaaatccaaggcgatgggccgattcctgcgccatgtgcggttggtttccttgcgtgacgtggccggaggtcgtgccactgacgtgattctgtcgatgtgctatgcgaaaaccacgcacggacgtctgcttcagcagttcggtccgctcgaaagcacaggcggtcgcggactgttgctggatgccctggcattggcggaccacagcttggatattgtgtcggcctttggttccgaagatttggatgaagaacgactgcaccaatccggtcctcggttcctgaagaccatgttgacgtgggccgaacagcttgacgaccgtccggtgcttccgttgcgtgatgcggcaggcggcaacgtgctgttcgacgatatcgccgacaggttgcgcgcgcgaggactgaacgctgctgttgattatggattcgacaagggcgtgaagattccgctcgtggtgggattgaaggacaagccgtttgccttggccgtgcagaccgatgacgcgaactttatgtccgtgcaatccacgcgtaggcgtcatcgtttgtcggcacaggatctcatttccttgggctggaatgtgatgaccgtctggagtgtcgccgccttcgtgaaccccgataaggaagtcgaccgtatcgtcagccgtatcggtgagatctatcgcgaggttgaataa

SEQ ID NO: 1909 - DNA, 4185 bp, Bifidobacterium longum
atgagcaaagggtatggtgtgtttggccatgttcccgataatgcggatgacgatggcctcctgccttatgaggatgatgattccggcgtttcctggggccatgcgttgcgtcgtcgcaatccttggaaaagaggagacgacgaagatgccgattacgacgacggtcggtatgacatagatgacactgatgacactaatgggggcaggggcatctatgccggtaaaagcggcggagtaggcggcatttctggtgagacgggtggaatacttggtagctcaggcgcggccggcagcagagacgtaacgtttggtggaacggacagtttgtccgccgccgatgcggtgatgccctatcgtttcaggcaaggacgttccgtatggttcgacgatgaggacgaaggccatttcgccgggtctgcgaagcgtgccgaagcccatgccgtccctatccttgcgttacgcaacgatgtggaatcgtcatcgtcgaatgccgtgctcgctcgtgcccgtagcattgcgcgcaaagcggccaccatggttatcaatccggtatacagcgaaaatcatcgaaccgggtatgccgagcttgacggtattctacgtggcaccaccagcccatcgagtaggtatcgtaccagcgtgcaattcgacctcgatacgggagaagccgtcggtggcaagtgctcatgcccggcttacggccgtggctatggcatgtgcaagcacatgattgcgctcgccttcatattctgcgatgatccgcagcgttttgaaggctaccgtgccggggccgcacgaccgtctcggacgctgattgactatatggagcacgccgataggcaagacgctcaagccaaaattcgtcgtcgcaatgcggttatgcgtcggtttgatgccacgcaagggaaaaacggtgcaaatgctcggcgtacaaaaagcggatacggctctcgtgccggcacccgaggcggcgggtatcagggtgacagcgagactgtgggcttggggcaggtgcagcttgtcccgatattgagtttcatcgacggcgtgtggagcgtggagttcaagatcggctcggcttccaatgggtccagctatgtgctgaaatcgattccgcaatttgtgcttgccatggcgaacggcgactatgcggattatgggcagaagcttgcctttattcatacgccggatatgctcgatgatgattcgcgccccctgctggacgtccttgatgatgcgatggccgtgcgtcgtgcggccgagcagcaggacaggtattacgggcatatcgccatcgaccgtcatctgacgctttcagcaccggaagtggcccggttgctgtccgtacgtgagggcagaggcgtacagctcgtgctgaacacatggttctccgggcagcctgcatcggtgccagttgatggtggcgagccagattttctcatgcgcattgcgcggcgtgatttcaatacgtatggtccggatgccggatacctgcttaccggagtgccagcggtggaaaccgtgattgacggcggcaagaatgtatggctgttgctcgcctccactaatccggccggtgcggtatccgccatggtggcgggctctcagcgtaaaagcgcagcaggatgccgattcgtccgttgcccgaaacgattgattccgttgcgaggactattgggagacctgtttgaacccgatggcgagggacaggtcattgccggcgatgacatcgccctattcgcacgcacgctattgcctcagctggttggtgccggactgttggaggccagtgagattcctcgcgagctggctgaattaagtcctacggaatgcagcctccagttttatctggatcgtgatgagcatggtgtgcaatgcgaggtcaaggcacgctacggcgatgccattgtcccgttgctacccgatggcccgacggtgcatgctgagggcgagcgttccatccccttgtctcggggcgtgattgggcgtgatttcgacgctgagcatcttgcgattgatgtagtgcgtgaattctttaccatgcctgaccagcgcaagcgcgttgcggccgccactcatcagacggtgaatgggttccgaacgccggccgcgcgaaaggccaccaaaaaattcgtgtctgatgcggccactatcgatcgcgatgacaccacgcagatcgttcgtctctttgacgagggattgccggcactaaaggaagtgggggaggtcttcaccacaccggcttttgaccggctgatcgcgcccaagccaccaagcgtcaaagtcggattgtccatcaaaggcaacttggtggagatatcacccctcgctgatgaagtgccgccggacgaagtgggtgccttgctatcttcgtaccgtcggcgtcaacgattccatcagttgaaggacggcacgcttgtcaaactcagcggcgcgaatctcagcacgttggaccgattggccagcgacctcgatctgagcgagcagcagctcaactccggactgatcgagttgccgggcggtcgagcattcctactggatggtgagctgccggatgacggctccgatgtagtcaaggacgcttcgttcaccgaatacatcgacgatctcaagatcatcgaccctaagtcgtatgaagtgccggatagtctcaagcatattctgcgcccttatcaggtcgaaggctttcaatggctgaacacgttgtgcgacaagggttttggcggcattctggccgatgagatgggcttgggtaaatccgtgcagcttatcgcgttgctcctgtctcgatatcagcggaataccggcgagatgggcaatggcagccttggcccatcgctgatcgtgtgcccggcgtccttggtgtacaactggggtgccgaattcaccaagttcgccccgagcttcaatgccgtggtggtggccggtaccaaagccgagcgccgtaccgccatcggccgtgcgttccgggcggatgaacccaccgtgctcatcacctcatacgacctgctgcgccgagatgtcgatgattacaccgccaatgagcaacgtttcaatgtcatggcattggatgaagcccagtacatcaagaatcacaccacgaaaatagccaaagcggtcaaggccgtggccgccgaccatcgtttcgccttgactggcacgccgatcgaaaaccgactctccgaactatggagcattttcgacttcctgatgccggggctgctcggctcatataagcgattccatgagcgttatgagttgcccatctccaatgcccgggccgcggatggcagcacggctgaaggtcgggccgccgcacaagtcaatcctgaggccgctcgggtatctcgccaattgcagtcgttggtgggcgtgttcatcaagcgcaggctgaagtcccaggtgttgaccgatttgccggacaagctagagaccacgctgaccgtgcggcttgccggcgaacagcgcaaactgtatgcggctcacgagcagcggctcagaatgcagctcgaacacagcgaagaagccgatttcaacacgtcgaagattcgcatcctcgccgagttgaccaagttgcgccagatctgctgcgatccgaggctgctgtacgccgatgccaaggatcaatcggccaagcttgccgccatcaccgaactggtggaaacctgtgtgaacgaaggcaagaaggcgctgatcttctcccagttcaccagcttccttgatctgatcgccgaacgtttcgacgcgcaaggcctgcgctactacaccatcaccggctccacgcccaagaagaagcgtctcgaactcgtcgaccagttcaatgcggacgatacgcctgccttcctgatttccctgaaggccggcaacaccggactgaacctgaccggtgccagcgtggtcatccacgccgacccatggtggaacgccgccgcacaggatcaggccaccgaccgagcacatcgtatcggccagaccgaagacgtcaacgtgtatcaggtggtggccaaggacaccatcgaagaacgtatcttggagcttcagcatactaagagcgagctcgcccgccagttcaccgacgcttccttgcttgccgacgaagccggcaccggcgccagcgccctcaccgaagcccccgcctccatcgccaccctcaccaaggacgatctcctcaatctgctggggtga

SEQ ID NO: 1910 - DNA, 1353 bp, Bifidobacterium longum
atgtcaatacgcaaggagctgaccgcccagaacgtactgctgggtttccagcatgtgcttgtttccaacgtctggcttgatccggtgtttgtggccggagcaatcggcttacctattgccctgtcgtcgaacatgattaacgccatcttcatcgtctctggtctggttactttggttcaggccactcggctggttcgcctgccggtggtgcaggggccgtcagccgcgtttgacgcgttgatgatcgcggcaggtacggccggcatgctgggggcggcgagttcgtccattctcatcgcttcgcttgtgttcctgttgctgtgcctgaccggtgtgatagagcggatgcggttcctgttctctccgatgatttcgggcgtggtcatctttatggtcggtgtctcgctgtctggattcacgctgagcgagtttctaggcggggctcccggcgacaagacgttcgccgatccgcacatcctgaccgtgtcgattctgaccacggcgattgtgcttgtcctgtcgttgctcggcaagggcctgctcaagtcgttctcattcctcatcgcgctcgtcgtcggcaccgtggtcgccgcagcgtttggcatggtggacttctctcctgtggcatccaagggatggttgggcctgccgaccttcctgccctacggtccgttcacatttgactggaagatcttcatcccgttcttcattgcctacatggttgccgtcatggaagctctcggcgtctatcaggcggcttctgagattcagggcacgtccctcgaacgcaagcaggtgcgctacggtcttgccggcgaggcggccggttcagccatttcctcgctgattggtggattcaccaccaccgcctacccgcaaaatgtcggcctgctcaacctgaccggcgaaggcaagttgcgcacgcgcacgcctgtgatcatcgccgctgtgctgttgctgattctgggcttcgtgccaaaggcgggcgcgttgctgtccgtcattccctcggcagtcgtcggaggcattttcctgccggctgcggccagcctaatcgtgaccggcctgcgcgccctgcgcaaggtcgctgatgacgagcgccgtcaaacggtcatcggcatgtctctgttgctcggcatcgccctgcccaaggcgctctccggcctgaccggcggcgcaagcgtgttctttggcaacaacatcatggtcggtgtattcagcgccatcattctcaatgcgcttttcgtcgctcttccggatttggtggcgaagcatcgtgcgccggcgtccgtggatgttccagcagccgatccggcggatgggactggcgctgcggcgtacgatgaacgataa

SEQ ID NO: 1911 - DNA, 2514 bp, Bifidobacterium longum
atgaccttcgaccagtccagtatcaccaataccaataccgctgcgtacgccggatcgagcggcacatacaccggcacttcctccggcacgtacaccgggacctccaccaccaccggctcctgggccgactccacacattcggttatctggatgaccagaggcaatgtgcttcgcggcatgggcctcagtcgccagccgtggggcaaacgaatcgccagcctcgtactcatagcggcgatgatgttgctggcgcaagccaatctcatcgacgtgtacggcggcgtggccacttgggcgattgccgctgtaccggccaccttgctgggcgcgatcatcgctctggcgggcatgttgccggcgttgcgactgtggtggcaaatcgtgtttctggcgtttgcccaattcatcatcggcccggtggtaacgctgagttccactacgtcccattacgtgattcccaccttgaagaccttgagttcaggttgggaaatgacgtttggctcgttcaagtacattatttccgtcgatccgcctctgggcacgcaagacggcgtgctgatggcggtatggaccatcggcctgtggcttacgttcttcaccggcgtgtttgccattaatgccaacgcatggttgtctctggtgggagtgctgccccttgcggcggccgtggccgtatgtgccctgctgggcacagacagcggctggcaacgcgccatctgcggtattgcctttgccttgctgctgattatctggctgtcttggcgtcttgaactgctggaaggggggcgctggatatccgcgctgatcatcgtcgtgctcgctgccggccttgctttcgggggcacgttgctggtgccacaggaccgtttcgtgctgcgtgaccgctacgatccgccgttaagcccctacgattacaccagcccgctcagcggcatgcgatcctatatcaaggaccacaaaaaagacgtgttgctgaccgttcataatctgccggccggaacaccggtcaaacttgcggtgatggatcgattcgatggcacagtatggaacctgtccgattcttccgaagccacggactcctcgaattatcatcgcgtgggcaccacgatcaaggcggatgagcagggtaaatccttcactgcgaccttcaccgtcgatcaggaactgaccgacacctggctgccgctggcgggagcggccactggcgtgagcttcgccaacgatgccgacaacggcaatgacacgttttactacaacacggataccgattccgccattattcccgccggcacgcgtaaaggcctcacctataccgaatccggcattatcgcccgcaagcccaccgataagcagatcagcagtgcggctgcggcccgcatcacccaaccagaagcccaggatgttcccgattcggccagcaaactggccacgtccattgccggcgggcagtcctcgggcggtgccgcagccacggcgttggccgacacattgaaagactccggatggttctctcatggacttgaaggcgaccatccctccgatgccggccatggcaactaccgcatcaacaagctgctggcaggcacggccatggtgggcgactccgagcaatatgcctccgccatggcactgatggctcgtgatctgggactgccctcccgtgtggtcctgggcttcctgccgaaaaacgaggatggcgaaatcaccgatgcccgcacggagaagacctcgggcaatggcaccaaaatcgaattcaccggcaacgatgtcaccgcttgggtggaaatcaaattgcagggcctgggatgggtggcgttctatccgacgcccaaggagaccaagatgcctgatgaaaaccagaacctgacgccgccgaatccgcagacgctggtccggcaaccaccagtgccgttgaccgatccgctgcgcgatcagacgcaagccaagggccaaagctcattggccggcgccgacgccgatgattcgccgaccaacctgttctgggcgcggttctggcgagtgacccgcaaggtggccctgtacggcagcccattgtggaccctactcatcgcctgcggtctgattctgatgttcaaggccatactgctggcacgagcgcggcgacacggcagtccgaaagcccgtgtggcagcaggttggaatgccatacgcatgcttgccgagcaaagcggcatcacagccaagggcactcgtcgagatcaggccggtgccatcgcccgtcaactcggcacagatgaccaggctttgatccagcttggccgggaagccgactacgccacgttctcggggcaagacattgaatcgggccaagccaccacatattggacaggagtcgaccaattacgcaaggcaatgctcgcttctttgccgcgtttcaggaggatacgtacacgactttccctgaaaagcgtggctatactgtcaaatgggcacgcagcaaagccgcacacgacgcatgtcaagcgcacgcgtaagaaggggaaggcgtcatga

SEQ ID NO: 1912 - DNA, 3570 bp, Bifidobacterium longum
atggtggagcgcatggctgattacgggaacaactttgtgcaactgcataaccatacgcactattcgctgctcgatggtgcgtcgaagattcctgatttggccaagcgtgcggccgaacttggcatgcctgcggtcggtatcaccgaccatggcaacatgcatggcgcctacgagatgtacaccaactgcgtggccaatggcgtcaagcccatcatcggcatcgaagcttacgtgaccccggaaaccgcgcgtcaagacaagtcccgtgtgcactggggcaccgaagcccagcgccgcgacgacgtctccggtggtggtcttatcacccacttgaccatgtgggccgaaaacgacgaaggcctggtcaacctcatcaaagcctcgtccgtggccaacctcgaaggtcgcgtcatgcgctacccgcgtatggataaggaggtgctcgccacctattccaaaggtgtgatcgcctcctccggatgcccttcgggcatcatccagactcgtctgcgcctcggtcaattcgaggaggccctgcgcgccgccggcgaattccaggacatcttcggcaaagacaacttcttcatcgaactcatggatcacggtctgacaatcgagacccaggtcaccaacgacctgctgaccattgccaagaagctggacgccccgctgctggccaccaacgattcccactacgtacacgccgaagatgcacaggcgcaggacgccatgctctgcatcaactccggttcccgtcttgacgatccggaccgattcaagttcgacggcaccggctactacatcaaaaccgccgaagagatgcgcgaactgttcaaggaccacccggacgcctgcgacaatacgctcgttatcgccgaacgctgcaacgtgatgttcgacgaccacgaagacggcgcgttcatgccgaaattcccttgccccgaaggctgggatgagacctccctgttcctcaaaaaagtcgaggaaggtctggagaagcgttacgacggcaacccgccgctcgacgtattgaagcaggccgactacgaatgtggtgtgatctgccagatgcagttctgcggatacttcctcgtggtcgccgactacattcagtgggccaaggaccacggcattatggtggggccgggccgtggttcggccgcaggcgccatggtcgcctattccatgggcattaccgagctcgatccgctcaagcatggcctgattttcgagaggttcctgaaccctgagcgagtgagccttcctgatatcgatgtcgacttcgaccctgaaggtcgtgcgcgagtcatcgaatactgcggcgaaaaatacggcaccgataaggtcgcccagtgcgtgatctatggcaccatcaaaaccaagcaggccctgaaagactccgcccgcatcatgggttatgaattctcagtcggtgaaaaaatcaccaaggcgctgcctccggcggccaccggcggcaaagacatcagtctgcatgacatcttcgaccctgccgccaaacgttatgccgaggccagggaattccgagaactctacgattccgacccggacaccaagcgcatcaccgaagaagccaagggtatcgaaggcctgatccgacagaccggtgtacatgcctgcgccaccatcatgagtagcgcacccatcaccgacacctcgccgttgctggaacgcaccgatggcaccatcaccaccaccttcgaataccacacgtgcgaaacgttggggctggtcaagatggacttccttggcctgtccaacttgacgatcatccacgacaccctgaagaacatcgaggccaacggcaaacccgccatcgactacaccaagattccgctcgatgacgccgaaacctacaaactcatgtcccgaggagacacgctcggcgtgttccagctcgattccgacggcatgcgttcactgctgaaaaccctgaagcccgataacttcaacgatatttccgcacttatcgccctgtaccgaccgggcccgatgagtatggattcgcacaccaactatgccaagcgcaaaaacggcctgcagaagatcacgccaatccaccctgagcttgaggaacctctgaagcaggtgcttgacgagacctatggtctgatcatctaccaggagcaggtgcagtccgccgcccgaatcctcgccggctattcgctgggcaaggcagacgtgctgcgtcgagccatgggtaagaagaagcccgaagtgctggccaaggagaaggtgccgttcttcgccggtatgaaggagcatggatactccgaagaggcctcccaggccgtgtgggatattctggtgccgttctccggctacgctttcaacaaagcgcactccgccgcatacggtctgatctcctactggaccgcatatctgaagacgcactacccggtcgaattcatggccgccctgttgcaaggtgccgccaccaacaaagacaagaccgcactgtacttgggcgaggcccgccgcatgggcatccaggtgctttcgccggacgtcaacgaatcggtgtacgagtactcggcagtcggcgacgtcgtccgattcggtcttggtgccatccgtaacgtgggtgacaaggccgtggccgatatcatcgccgaacgcgaaggcccgcgcggcaagttcgtgaacttcatggacttcatccgccgcgtgcccctgaccgcgctgaaccggcgattggtcgaatcgttgatcaaggccggtgccttcgactcgattgacccgaaccgtcgcgcgctgttcaccgtgcacgaggccgccatcgactcggtggtgagtctgaagcgcaaacaggcggagggccagttcgatttgttctccgatgccgaggatgggggagcggaggccatgggcgacgcttccgtgaccgtacccgatcttgaggaatgggacaagaagaccaagcttaacttcgaacgcgaaatgttgggcctgtatgtgtctgaccatccgctctccggtatgcagtcgattctcgcgtccttgcgtgaaatgtccatcgcgcatctggttgatcgagccaaaacgatgggtgaaggacagcaggtcacgttggctggtttggtcaccaatgtggaccggcgcgtatccaagaagggcaacccctgggccatcgtgaccatcgaagacatggaaagctccatccaatgcatgttcttcggcaaggtctatgaagcggccgccgccgaactcgccgtggacgccatcgtacagattcgtggccaagtggagttgcgcgacgaaaccgtttctctgagagccacggaaatgcagattccgaccttggaagccgaggatgaacgtccgttggtcatcacgctgccgccggtggcgttggagcgccaacgcatgatgcaactcggtcaggtgctcgctaatcatcctggttactgcgaagtacatcttgcggtgctggatgagaagggtaacgctcaggtgctcacgtttggcgatcgtttccgcgtcaagcgagatacttcgttgtttgctgagatcaagattctgtttggccccagctgcttgcctgccgcctga

SEQ ID NO: 1913 - DNA, 2268 bp, Bifidobacterium longum
atgcgattcacttcagggcattcgagccataaggctgtggggcgtaggagaagccgccatgccggtaacgggaaatccaatcgctccgcatctacgaatagcgctgcaaatcagcagacgggtcccgtaaacctgaagactccccagcacgtgggtggcaacggccgttcgctgatcagccgtacaccgatatgggcgcgagtggtggttgtactgctgctgacgttgctggccagcgtcacctgtgtgggcacgctctacgcggcatccgtctcgagaatggccgcggatgcgcagcgtgtgctgacatccgccgaaagtctggccaattcggcacttggctgtggcagcgataagagtctgtcggacatctcccaagagctggtcaatgccaccaatgatctcaatgcggagctgaacggcccacagtgggacttcttccgcgaccattcgcgattcggaagcgacatcaccgccgcccgcgaaatgctggcttccgtggatacgctggtcaacggtccgttcactgatctgctgaacctgtccaaacgattgcagggcttctccctgaagaatggctcggtggacgtcagcgccctgatggatatgccggatatcgtcaagcaggcgcataaggatatctcgcagcagctcaccaagctcaacaaggtgccgactccgagcgtcgccaaggtggccaccgtgctcgaaaccgaaaaggctgcgctcaagaccgtggattcgatgctcggcgaatacgatggcctcattaacttgctaccgcaactgcttggcgaggacggcaagcgcacgtatttggtgatggtgcagaacccggccgagctacgttcggcgggcggcatggtaggcaccatcgccgcaatcacggcagataagggcacgattaccatcggtgatttcgccaccacttctggttgggacattcctgaggagccaatggatgatacggtgctgaaggagcgccaggtatttggtggcacttttgaccagtacccggccaccacgaccatcgaccccgaattccagcgtgtggcacagatgaacaaatacatgtggctgtatcagaaaggcaacgaagacgagaacgtagcgggtgtattgtcactcgatcccgtatttctccaggcattgctgggagccacaggcgaggtcaagctttcggacggccgagtgctggatagcaccaccacggtgccgttcttcgcttcagacctgtacacggattacccggacttcgagcagcagaacaacttcgtttccgaagcggctcaagcaattatgaaccatgtgcttggcaacgcgaatgcctctaccgcatccccgctgttgaaggcaattagagataccagcgctagcggtcatttcaagctatggatggctgatccggatgagcaggaggcgctgattgccaccggacttatcgacgataaggccagtggcgagttgtctgctgacagtcaggtgcccgaagccggcatctatctttcggagctgcagcaaggcaagcaggattggtatctgaagacctccaccacggtcacaaaaacctgcggcgacgcctcagccagccagaacgccctgtattctggcgtgctggataagcgcatcacgacagccgtgcgtaacacgcatctgggtcagtttacggaagatcagctcggtgacgaatacacggtcaccttcaccatgaagaacacgctgactaaggctaaggccgaatcgttgcctgatttcgttaatggcggctcggagaatccagtgctcggcggcatgttgtaccgcgtggtgcttaccgctccgtacggtggcgagatcaccgctgtgcaggctgatatagattcatggggtaccaacaccgcgagcctgtatgaccgtcagtacattatgttcaaccagcagtggatcgagcccggaaaagaattgacgattgcttataccgttcgggtcagcagcgatgccacacatccactgaacgtggtaaccacgccggtggtgaatgcggatggcgtcgagacgggctccaacggtaatgtgaccgatgagtgcacggcggatacgaacggcgccgatggtgcgaacggtgccgatggtgcgaacggcggcgcgaacggcggcgcggacggcggcaagaacgacgcgcataaggacgcgtcctccgatccctcggccggcctggacgccttggacaagttgaagagccagatcagctgcccggtcgatctgaagtccctggcgggatccatgtga

SEQ ID NO: 1914 - DNA, 2532 bp, Bifidobacterium longum
atggctgagtcgaaccaaaggaccgcacgtgcccaaaaagcctcaaaggcccaaaaagcctcaaaggcccagaaagcccagtctggtgccgccaaagccaaggcccgacaggaagaagaagcactgctgagggccgacacctttaccaacgctcccaaggtgtcccgccgcactctcaccaaggaggagcgcgaggcactcgccaagcagagggaagctgaaaccaaagaagccgagaaaatcgccagcgcatggtcgaaaggcggcctcggtcgatggtgggcccgcctgcaatccagcccagacaaggtcacctggggcatggcaatcgtggcgctcggcgtggtgtacggcgacatcggcacctcgcccttgtacaccgcgcagaccttccttgccggtcagggagggcttggcagcgtagaccgagaggccgtgctcggcatgctgtcgctggtcttctggtcgattacgctgatcactaccgtcaaatatgtgctcatcgccatgcgcatcgacaacaatggcgaaggcggcatcttcgcactgtactcgttgattcgcaagtacggcgcatggctcgcgattcccgccatgctcggcggcgcggcattcctcgcggattcggtacttaccccggcggtttccatcagttccgcagtcgaaggcttgcagaccctgccgccattggaagggttgttcgacgaaaacccaagcctgaccctgatgatcaccgtcgtgatcatcgtgattctcttctccgtgcagtcgcgcggcaccgaaagcatcggcaaagtattcggctcgatggtgctggtctggttcggcttcctcgccatcgtgggcgtcacgaatctctctaacgactggtctgtgtttgaggccctgaacccggtgtacggcatcaaattcctgttcagcccgcacaatgctgccggcatcgcccttatgggcaccgtgttcctctcgaccaccggtgccgaggcgctgtactccgacatgggccacgtggggcgcggcaacatctacttcacctggccattcatcaaggttgcgctggtgctcaactacttcggccaaggcgcgtggatgctggccaatagcgataacccgcaatacactgcgacggagtcactcaacccgttcttccagatgatgtctccgaacgtacgttatctggccgtgattctgtctgtttcggccggcgtgatcgcttcccaggccctgattaccggcgcgttcaccatggtctccgaagccacccgcctcaattggatgcctcatctgcaggtgcggtacccggcccgcacgcgtggccagctgtacattccggtggtcaacggcgtgctgtgcgtctccacgctggccgtactcgccatcttcaaggattcggaacacatctctgccgcatatggactggcgttgaccattacgatgatcaccaccaccgtgttgctcggcgtccacctatggcattccggcaagcgggtcggtgccatcgtgttcaccgtgctgttcttggcgattcaggctatgttcttcatcgcgtctatggccaaattcctgcatggtggttggttcaccatgttgctgaccgccgcgattctgttcgtcatgtacacgtggaatgagggcaccaagctcgaacgtgcgcaacgccgtcacatgcggcccaacgacttcctacccgcgctcgacaagctgcacagtgatttccgcatcccgtattttgcggacaacatcgtgtacctgacctccgactcggaaaccaagcgactcgacacggacatcttcttctccatcttcgccgaccaccccaagcgcgcccgtgcttggtgggcagtcagcgtggaaaccaccgacgagccgttcacccgtgaatactcggtggaggacttcggcacgaactacatctaccgcgtgcgcttccgtctgggattcaaggtttcgcagtccatcccggcgtacatccaccagatcatgcacgacctgtccaaaaccggcgaactgcctaagcagaagtcgatttaccccaaggtcgacgccgatccggacatcggcaccatccgttacgtgctgattcacaaggccctgatgccggaatccaaggtttctgcacgcggtgccctgtcgttgcaagccaagtacgcaatccgccacatggccggctcgccggttaagtggttcggtctggcaccttacaacccgttggtcgaggtgcagccgctgttcgtctccacccgccgcccaccgcgtctgaagcgcaccgatacggccaagaccatcccgacgcccacgccgactcgtgcagtggccgacccggccgccgtccctgacccgatggacaccacgtccgggcttgggcgattggtacaggagctcgatgccgccgtatcggccgaggcgcggaagaccgctgaggccgctgccgccgatgcgcccgctgagcagggcgataagggcgataagggcaaggccgagaacggcaaacccgccgccaagcctcagcgctccgccaaacagaagcgataa

SEQ ID NO: 1915 - DNA, 3873 bp, Bifidobacterium longum
atgagttcaaccgtaggtcgtaattccctgatcatggccacgggaactgctgcttcccgtgtgaccggtcagctccgcacgattcttctcgctgcggccatcggcaccaccggattggcggccaacgcctatcaggccggttccatgattccccaatccgtgttcacgctggtgtctggtggtattttcaacgccgtgctggtgccccagatcgtgcgcacgttgaaagaaaaagacgcccaagaacgactaaatcgtctggttacgttggccatcggcatcctgttggccatgaccgtggtgatggcggcggccagccctctgcttgcccgcctgtacgtgggtagcgacgatcaccagatgatagccctgaccacctcgttcaccctgtggtgtatgcctcaggtgttcttctacggcctgtatacggtattgggtcagatcctggccgccaaagaccatttcctcacgtatgcgtggagctcaaccggtgccaacattattagttgcgccggttttactggttttattctgctgttcagcaaggccaatgaacagcccctcgaattctggaccgccgacaagatcgcgcttaccgcaggcacctggactttgggcgtggccttccaagcgctgatactcttcctgccactggcccgtatcgggttcaagtacagacccagcttcgggcttggcggctttggactcaggtctatgggtcccgtggcgttaggctctttgggcgtggtggtcaccagcgagatctgcggcattatccttacccgtatcgccacatccgcaccgcagcgcgcccacgaactgacgggtgccagcctgttcagcgtggcaggcaacgcgacctatcagaatgcgtacacactgttcatcctgccctattcgctcatcgccgtatcggtatccacggctatgttccccaaaatctcccgttctgtcgcagctgcgaatctggatgaggcacggcacgacctagtcaacgcactgaataatgtgggcctgctcatcatatttttcgccgccgccatgattgtgttccccgaaccgattatccgcgcattgcttccgtccgtctcgatggacgagaccatgctgatttcctacgcgcttatcgccctatctgtgggcactcctttgggatcggcgttcctgctgattcaacgtacattctatgcctttgaggacggcctgcaccccttcttgtctgcggtgatgcagtatgggttcacctcggtattcatgatcatcggcatgatggtacttcctcctgagcattgggtactcggcatcgcctgctcggtgacactcggcggattactggcgttgccgctgacgttgatgatgttgcgccgcaagttcgaaggcaatcttggcggtcgggagatcacgaggacatacgccaaggccattgtggcggcactggcttccggagttgtggtctggctgatcaaacgaccggtagtcgcactgttcgacgcggatattcgaccagtaggcgggcacatgagctggtggtctgcgctggccatctgcgtggtgctcaccatcgtgctgaccatagtatatgtggctgtgttgtgggtggtacgcaccccagaactcatcagcgcctatcactcgatactggcccgtctacacaagactccggccagtgaagacgttgctgtgacagcccagccggaaaaagtcgacgatacgcaaatcaatcctgagacggagcccgtcaaggatagccccgcacgtagaatatctaagaccagtctcgaacaccaatcacacggagccgaacgcactatgaaaccgcaactcggagacacaattctcaaccgatacaccttggtatcatcgttgcgtgcggagcctggcattcaggcatggaaagccaacgaccgtgtgctggcaaaggattgccagctgttcatcattaccaatcgcagcgctttcgccgcaatcgatgagctcgctggtcgcatcgccgccactcgccctgatcgtgtgattcccgtactgaaataccgtatggaatccgacgtacttctcattgtcatgccggtggatagcggccaatgcctgactgactacatggtggataccgccaagccgctcagctacagcgccatccggtcgattatcggagaatgcgccaacgtgctgcgcgagatcattgcggatactcccagcagcatcgtcatcacaaccgacaccgttcgagtgactacctccggtgtgcaaattgccgatgcaccatgtgccacgatgctggccgatacgtccgctaccgatctgcgtacggacagtcctgaacggtatgcgattcgccagcttgcggcattactctataccctgctgacacgcacgccaagccaagcgacacccacattcaatctgcgtgccttgccgcaagacacccctggcgaattccgcgtgatttgcaagcgtggattggccttgagcgagcccgacgagcatacgttgccaatggctgcccttgtagaactcgacgccttgttgggtaattggaagccgctctctgaactgagcgatgctgatattgctttgccgagcgtggaaagcgattgctcgattaccaaggcgatactgaagcctgccaacgagactgatatcgtgcctattcccagcacgttgattaacagcagcagtcttccggaattgtctattaccccttccctgccggttcagccggccgccgtccccgctccgcacgtgatgtcaccggttcctctgactgatgggtccagtattgctgacggcaaccagtctcagtctgatgcccaccgtctgtttgacttcaacctttctgacgcctgggagcacgagaatctttccggtgaagacaccggtgactggtacagcgaaatgaatccagcccccatcggcggtccgagtgataatactcggttgacagtgcctattgttaccggcggtatttccgacgccaccgtgggagagacaaccagtcgtattcccatgttcctcgccagcggccgtgctgtggctcctggtgaggaatcgctgcgtgccttggaagaggagcaggcccgcattgccgaagtaagcgccattcctccgagcttcacaccgaaggatgtgccggatgacgaggatgacagcaagctacccgatgaacatctgttcggtaaactgtcgaccaaggtcgttgccatcattgtggctctgatattggtagtggcagcggctgtttgggcagtgtatgcgttccgatcctccggagacaatcctgccgatgcttccagcaactccagtgaaggtgactggcctgatatcaatgctgacgctgtgccattcggtggcagcaagaacgcgacgaacggtggcaccactgacgattcttcaaagtcaagtgatgccactcagagcgaatccaaggactcggcatcagacaagtccaagaagtccgagactgctgattcgtcgtccaagaagaccaaggccaaaaagtccggcgataaggattccagcgctgctccgcaaccgcgccatgagaacaacacggcgtttacgatttccagcgccaacttcctgtcgaatcctggcggccaatccgggtacgcatactacatgcaccttgaccagccgcaggatgcgtaccgcatggttatcaccatccgcacatccggtggtaagggctatattcgcgcgaataccactggagaccccactcagggcaagcaggtggccgaattcacctttgctgaaggtggcactactgaagtgaagttcaccaaagccgtcaatacgcaggatctgctgctgtgggtgccatcggatagcctgccgcagagccagctgtacatcgagaaggtggaggtcttctaa

SEQ ID NO: 1916 - DNA, 2184 bp, Bifidobacterium longum
caaggaaggcaggcacgcacgatgaacaccatgtggaaactgtttaccggcgacatcaaacgcctgaccagcaacgtggtctccatcatcatcgtgatcggcttggtgatgattcccggcctgttcacctggttcaacgtggccgcatgctgggacccgttctcgaatatgaagaacctgaaattcgcggtggcgaatgtggatgaggggtatcgttccgacctgatcccggtgaaagtcacggtcggcgatcaggtggtgaacgcgctgcgcgccaacagtcagctcgattggacgatcacgtccaaagccgatgccgtcgagggcgcacgatccggcaaatactacgcggccatcgtaattccgaagtcgttcagcaaagacatgatgaccttcttctccgacgacgtgcagcatgccgaactgacctattaccgcaacgagaagaagaacgcgctggcaccgaatctgctcaacgagggcacggatgaggttgcggcggaaatcaacaccacgttcgctaagaccatcacttcggccgggctggaaatcgcgtcttcgctggccgatcagctgtccaagcccgaggccaaagagcaactgaataccttcaacgccaacatcgccaatttcgccacacagcttgacgatactgcggatctgcttggcacatacagcgcattgaccgatacggccggcgccttgctcgacacctcgaactcactaatcactcaggtttcctctgccgccaaacaaggcggcaaggatcttgccagcgccaaacaggaagtcaccgacgtggccggagccctgggcaccaccgctgacgcgatgagcagcgcactggacgcgagcgcctccagtttcggcgcggtgtccgattccatagacaagctgtattccgacgcgaatgatggtgccaccacggtcgccgacgaattggaccgtcaagccacggccattggcaagcagacggagaaatacactgaaattcgcaacacgttggccggcatactgggcaacgactcatccatcatcacggcgattgaccgttcaatcgcacgacaaaacaggctgcggcaagcgctgaatacggcggcgaccgatattcgccaaggcaatcaggacgcgcaggatcagcatgcgcaggtcaagaatctggctgatcaagcgcagaacagtattgccaatatcaagtcagatttctcggccacggtgaaaccgcaaatcgactccctgtcgtccaccgtcgctgacgcctccggcatactgagttccggcgccacccagttggactccacgctcggcgacctgaaagggacttccgacgacgccagcgatatgctcagcgacgctcgcactaccttggacaaggtgtccggcaaactgcgttccgccggcgccgaactggcttcgttcaacagcacactgagcgacgcactaaacagtggcgatatgggcatggtcaaagaggtgctgggcaatgatcccgaaacgctggccagtacgttggccgcaccggtgcagctcaggcgcaaggccgtattcccggtggcgaatttcggttcgtcgatggcaccgttctacacgctgctgccgctgtgggtgggcgcgctgctgatggtggtgacgctgaaaaccaccgtgtctcgccggacgcgcaaagcattgggcgatccgcggccgcatcggctcttccttgggcattacggagtgttcgcgctgattgcgctgctgcaatccacggtgtcgctcggtggcgatttgctgttcctgcgcgtgcaggccgtgcatccgctgctgtttatgttgtctggatggctggcctcgctggtgttctcgttcttcacctatacgatggtggtgagtttcggcaatgtgggtaaggcaatcggcgtgcttatgctcatcgtgcagatttcgggtgcgaacgctgcctacccggtgcagatgttgcccgacttcatcgccaaagtcagtccgctcttgccgctcacccatgcggtgacgatgatgcgtgcggccatcgccggcatctacgacatggattactggcgggccgccggaatgctgctggcattcgtgccgccgctactgttgcttgggctgttgctcaggaagccactggtgcggttcaaccagtggtatgtagcccaagtcgagagcactaaagtgctgagctag

SEQ ID NO: 1917 - DNA, 2757 bp, Bifidobacterium longum
atgcggacagtttggcaagtctttctgcgcgattgcagacgtatcttacgcaatcccgttgccgttgtggtgacgctcggcgtagcaatactgccctcgctgtacgcatggttcaatattcttgccaactgggatccctattcagccaccggcaatctgcaagtggccgtagccaatgaagaccaaggcaccaccaacgatctggtcggccatctcgatgcgggccggcaggtcgtcaagaaactcaagcagaacgacgaactcggctggcgcttcgtagacaatgaggagcaggccgtacacggcgtggagaccggcgaatactatgcagccatcgtgctgcccaaggatttcagtgccatcttggtcgaatcggtgaccggaacctccaaacagccgaaaatcaagtattacgtcaatgagaagaagaacgcgatcgcgccgaaaatcaccgacaccggtgccaccaccatcgatgagcagatcaactccgccttcgtcaccacggtagccaccaccgttgcctcggccgtttccgaagcgggagacgatctcgaccaagtcaccggcaaagtccagcacgatacgatcgatgatctcaatacggtgatgtccacgctgaacaccgttcaggattcactcaccgacttacaggacacgctggcccagtcagacacgattctcgccgacgccaaacagaccaccgcctcactcaagcagaccgtcgcggccgcgcagaaggcctcccgccagtccggcacactgttggcggaaacacaggccgggtcacaagccttctccaccacactggtcggcgcgctcgacaccagctcagcgcaactctccggactggccgttcacgtcaacaacgccgccggcagcatcaccggctccttcaacagcgcgcagaactccgtcgacaccatcaccaacacactttcggctccactgaacgccacccaaacgtcaatcagcgatctgaaaaacgcgctgaccaaagccggcatcggcaaagacaccaccgacccggccggccagaacatctggaaacaaatcgatgcgctcgactcattgatcagcaaacagcagacacagctcaacaccttccataccgacaccacacagttcatcaactccggcaaagacgccaccacgaatctttccggagccatgaccaacaccaccaccggcggcatcgcggcgctgaataccgcgcgcggctcgctgaccggcaccgtgatgccatcgctcacctcatcattgaacagtttcgccgccctgaacggcacgctggatggcacgttgacttcgttgtccggcaccttggatcaggccgacgggctgttcgaccagcttgtcgataccctgaaccaaacgaaaaccaccatcagcagcacgcaggattcgctgcgccaggtggccagcgatgtcgccaccgtacgcaccgatatcgccacgctcgatagttccgccgcttaccagaaaatccgggatacgctgcatctggatgacaagggattcggcgagttcatgggcaatcccgtcactctggccacgaaagtcgtgtatgccaccgacaattacgggtccgcagtcaccccgttctacacgaatctggcactgtgggtaggcggtttcgtgctgattgccatctacaagcttgaggtcgaccgcaagggcattcgccgtatcaccgctacgcaagcatatcttggccgctggctgttgctggtcaccatcggattcctgcaagccgtcatcgccaccatcggcgatctggtgctcggcatccaatgcgagcatccgctgctgttcatcttggccggaatcttctgttcgttcgtctacatcaacattatttatgcactggccgtggcattccgccatatcggcaaagccatcgccgtaattctggtcattgtgcagatacccggtgcctccggcctgtatccgattgaaatgatgccgaacttcttccgcgaactgcacccgtggctgccctttacctacggcatcaacgcgatgcgcggcccgatcgccggcctgtacgcgaaccattactggctcgacatgctgcacctgttctggtatctgccggcggcgcttttcgtgggacttgtcgtacgccggtatgcgatgaacctgaacgcgctgttcgaccgtcgtttgggagataccgacctgatgatcaccgagcacaacagcatggtgaacgaacaggtgagcttgaactccgtattccgcacggtgtccgacagcaaggaactgcgcgatatcatcgcccatcgcgcgcaccggttcttcgcacggtacccaaagatgatcgttgccggcctggcattgctgaccgtactcccgttcgtattcctggtgctgctgtttgtcacccaagagaaaatcgccatgctgacctcctggattctgtcgattattcttatcgacgcctatctcattgtggttgaatacgcacgcgaaacctacgccgtgcagcttggcgtcagcgccatgagtgccgacgagttccgcaatgtgatgctcaacggatatgtgtggcggcgtttccacggccacggacgtcacgaagcggcgatggacagcgatccggatatcggcgaaaccactgaacgactcacactgttcggcgatcaggccgccgagccgactgcgcacaccgcacagtccgagcagtccggtcaatccgggcagcctgagcaacccggtcagtccgggcagcctgagcaaggagacgcacgatga

SEQ ID NO: 1918 - DNA, 4734 bp, Bifidobacterium longum
atgtacgaaagcctgagcctgttttccgaacccaccaagatgtggttcgagcatgccttcggtcagccgaccgaggcacaggctcaggcatggccggcaatccattccggtcgcaatgtcttggtcatcgcccctaccggttccggtaaaacattggccgcgtttctctcagccatcgaccgattgatgaccgtgccacgcacgcggcgtgccggtgtgcgtgtgctgtatatctcgccgttaaaggcgctcgcggccgatgtggccaagaacctagaacagcctttggagggcattgctgcacaatgcgaggcgcaagggctgcccgtaccgaagatcgcggtcgccactcgttcaggcgacaccaccgcacaggagcggcggcgcatagcctcccatccaccggatatcctcgttaccacgccagaatcgttgtatttgttgctcacttcgaaggcagggcggattctcggcactgtcgatacggtgatcgtcgatgagattcatgcagtggcgggcaccaagcgcggcgcacatttggcggtaagtctggaacggctggagaaccttgtcacagaatcgcgcaagcgagatgcaatcgatgcagatgctgatgagggcggtgatgccgccgtcgatgctggccgtggcgatcgtcatatgcagcgcattggtctatccgctacggtgaatccgcctgaaaaggcggcgcgattcctgggcggcgggcaaccggttaccatcgtgaatcccggtgggcggcctgcaatggatttgcgcatgattgagccgttggaaaacatgcgtgatttgcagtccgtgaatgccaagcagcgtgtcggtggcgtggatgctgaacggtccgctccgcatatcagtggtgtcacgccggccatgcagcgacttgctgaacgcaggggcattgtgccggtggatgatagagatgtttcttccacttctggggacgattctgatgcgagtgatgcgttcgattcctccgcgttggttggagcggcgggcgaccgtacctccggttccatttggcccgtggtggaacgcagtattttggatgagattctcgcgcaccgcactacattggtgttcgttaattcgcgtggtgtggctgagaaactcactgcgcgcttgaacgatctgtatgcgcagacccggcatggcaccaatcccgacactgtgcgggatctgggctctccggaaggccgcgaagggttctccacgcattacgatgctgtggtcggctccaccaccatgcttgtcggctcacatgagggcgatgatgtcatcgccatggctcatcatgggtcggtttccaaagaccgtcgcaaaatgattgaggaacggcttaaacgtggtgaattgcgttgcgtggtggccacctccagtttggagctcggcattgatatgggctcggtcgacttggtgattcaagtcgatacgccgttgtcggtctcctccggattgcagcgtgtaggccgtgccgatcatcaggtcggtggcgtctctcacgcattgttctacccgctcacccgtcagcagattgtcactggggccgcaagtctggaagccatgattgccggcgatatagaaccattggccgtgccgcgcaatccgctcgatattcttgcccagcagaccgtggccgctgccgcgatgcacgatttgaacgctgatgactggtatgccacagtgcgtcgtgctgcgccgtttgccgaactgccacgtgacatgttcgatgcggtaatcggcatgatgtccggcgaatacaacagcgaggaattctcggccttccggccgcgactggtatggaatcgggataatggcctgatttccgcccgtcccggttcgcagaaagtggccgttacctctggcggtacgattcccgatcgagggctgtacaccgtggtcctgcctgaggcggacgccggcaaaggccagcgtcgcgtcggcgagttggatgaggagatggtctacgaatcgcgcgtgggcgatgtcattacactgggtacctccacatggcagattcaggacatcacccgcgaccgtgtggtggtgacgccggctcccgggcgcaccgcacgtctaccgttctggcacggcgaaggttccggccgcgactacggtttcagccgtaccatagcccgcttcacccgagaaatcgccgccggattagacgtgaagcggactgaggggaggtctgccgcagaaggtccagctgtcccaaccttcatcccaacaatcctcacccgtctccaccacgatggcctagatgccaacgccatcaccaacttggcccgcctactctccgagcaacaagccgccactggtgcagtccccagcgaccaaacccttatcgtggagcgcacacgcgatgaagacggcggatggcgcatcgtgctgttaagccccttcggccgccgcgttcacgaaccgtggtccatggccatcagccgcagactgcgccaacgctacggtttcgacgggcaggtatatgccgccgatgacggtatcgtcattcagctaccggacggtgacggacatattcctgctcaagacctgttccttttcgacccagaagacctcaaagcagatgtagagcgtcaagtgggcgagtccgtgctatttgccgcacgattccgcgaatgcgccgcccgatcactgttcatgccgcgatccgacccgggccgtcgcgtgcccctatggcagcagcgactgcgcgccgcacagctcctgcaatccgcacgtatggccaagaactttccgctgctgctggaaaccgcgcgcgaatgtttgcaagacgtatacgacatgcccgccctgaacgaggtgatgaccggattgcaagccggcaccattaccgtgaaggacgtggaaaccgagtcgccatcgcctttcgccgagaacattctctttggcttcgtcggcgtggtgatgtaccagtatgaccaacctcaggccgagcgtagcgcgcaactgctgtctctcgatccgcacgtgctcgaacgcttgctcggcaccaccgatatggcacaagtgctcaacccggacgtgattcgcgaagtcgaacaggaactgggggagcacactttctggaatgagcttgccgacgatgatgtgactggtcgcgtgacccgttacgccaaaacccatggtcctttcaccgccgatcagctcatagccgatctacacctcgatgctacggatgccgtgcacactctggatgtgctggctgccaaaggcgagttgctgcaaggccactttgtagatgatgacgagcaaggccaacagtggctccataaggacgtattccgccgtattcggtctcgctcattggccaaggcgcgtaaagcagtcaagccagtagaatcagaggcgttccagatgtttcttatcgaccgacaaggtatcgggccggtcggcggcgaacgatatgaaggtgctgacgggctcatgcgcgttatcgagcagctggagggcatatcactgcccactgcactctgggagtcggcagtattccccgcacgagtacgagactaccaacctgcattgctggatgagttgctgaccagcggcgatgtggtctgggtcggctcaaaaaccgggggaaccagtgcgatggaccccggtgaggttgctttctatccggcggattcaatattgttcagcggtgtggaacatggtacgacatcgaacgcctcagacgccaccatgccggaagcgattctgaccgcactggactcagggggagcgttccatgcccgtcaactgatggatgccgccaaacgtgcgtggaatgagaccgcggagccggacatcaatccaaacaccggcgaaatcattccgcaagagtggagcgaacagcagttcaaggatgccttgtggagcttggtctggcaaggtaaggtcaccaattccagcttcgcgccggtgcgtgcattaaccgcaggcgcagcaagcccgcgtaaatccactacatcacgtcgtcgtgggcgtgtcgctccgattcgccgagccactacggatatgacgttaggaggtttgtggtccgccgtaatcgggcaagctgaagccgaagacaccgaccagaccgaacgggcactcgcactggtcgagacgttgctggacaggtatggcgtcatcgcgcagccggtgattgacaaggaaaatatcccgggtggctactcagcgttgtatccggtattgaatcgcatggaggagcatggtcgactggtacgaggcatgttcgtccgtggtttcggcgcggcccaatttgccgagcgcgacaccgtggatgcgttgcgtcatccgtcagagcatcgcggccagtccgtggtggcattgagtgtgctcgaccccgcaaatctcagtggctccgccatcgcgtggccggacgcgcctgccggtgcgggtaaaccggcacgccgtatcggagccacggtcgtgctcaatgcgcaaggcgcgctactatacgcggccgccaaagccaagcacctgacagcgttcgatcaatcggtcggccatgaagccgctgtcaatgattccgacgaacaaatgcgcaagaccgccacagaactggcctacgccctcaaacgcaatggcaccggctccgtgacattcagcgacatcaatggcgaacccctcaacgcccgtcaccccttcgcccgcatcctccagcagtccggcttcacccccgttccccaaggcatgcggctgtactga

SEQ ID NO: 1919 - DNA, 3067 bp, Bifidobacterium longum
gtgtgttgcttgcaagggcgtatggtggatgccttggcagacaggaccgatgaaggacgtttgaggctgcgatatgcctcggggagccgccaacagggctttgatccgaggatttccgaatgggggaacccaccgaccgtcatgggtcggtaccggcttcggccggggggtacgcagggaagtgaaacatctcagtacctgcaggaaaggatattccgtgagtagtggcgagcgaaagcggatgatggccaaaccttgcgcgtgtgatacccgtcgggggttgcgcgcggggtgttgcgggatcgcgtgcgccggctccgacgggccggccggcagttgcagaaaaccatgtgtcaggggaaccgggttgaataccgggccgcagagggtgagggccccgtacctgaacgcgcatggtctgccgatcgcgtctcccaagtagcacgggtcccgtggaaccccgtgcgaatccgcccagaccgttgggtaagcctgaatattcctgtctgaccgatagcgaacgagtaccgtgagggaaaggtgaaaagtaccccgggaggggagtgaaacagtctctgaaaccgtgcgcctacaatccgtcggagcccttttgtggggtgacggcgtgcctatcgaaaaatgagtctgcgagtcagtggcatgtggcgagcataacccgtgtggggtatgcgtagcgaaggcgagtcttaaaaggcgtttgagtcgcgtgtcctggacccgaagcgggatgatctagccctgagcaggttgaagcgcgggtaagaccgcgtggaggaccgaacccacctgggttgaaaaccggggggatgacttggggctaggggtgaaaggccaatcaaattccgtgatagctggttctctccgaaatgcatttgggtgcagcgtcgggtcattacgtcccgggggtagagctactggatgcttgcgggcccgtatcgggtaccaacagcaaccaaactccgaataccggtgacgcgtatcccggcagtgagtcggcgggggataagcttcgtcgtcgaaagggaaacagcccagaccgtcgtctaaggtcccgaagcgtgtgctaagtgggaaaggatgtggagtcgcatagacagccaggaggttggctcagaagcagccacccttgaaagagtgcgtaacagctcactggtctagtggttccgcgccgacaatgtagcggggctcaagcacaccaccgaagacgcggcagtattttgtactgggtaggagagcgtcccatgaggggcgaagcggccgtgtgaacgcgccgtggacttcatgggagtgagaatgcagacatgagtagcgagagacgggtgaagatcccgtccgctggatgaccaagggttccagggccacgttcatcgtccctgggtgagtcgggtcctaaggcgaggccgacaggcgtagtcgaatggatgaacgggtcgatattcccgtaccggctttcagccgccaaaaccgaggcttggagtactaacctccgggtccgggcttactgctccttcgggggcgggatgccctggcctgttgggaccgatccttgtagtaggtcagcgcaggagtgacgcagaagggtagccggccgcggaggtggtcttccgtggtcaagcacgcagggcgtgggacaggcaaatccgtcccgcatgggtccgaggtgcgatgatgggggccttatggcccgatatccggtgatcccggctgccgagaaaagcttcggcgtcaggctcaaagccgcccgtaccccaaaccgacactggtggtcaggtagagaataccaaagcgatcgagcgaatcctggtcaaggaactcggcaaatcactcccgttccttcggtttaagggagacccccgatggtgaacacacttgctgtgggagcttttgggggtggcacagaccagggggtagcgactgtttaccaaaaacacaggtgcatgcgaaggcgcaagccgctgtatatgcactgacgcctgcccggtgccggaaggttaagaggatccgtcagccttcgggtgaagcggtgaattcaagccccggtaaacggcggtggtaactataaccatcctaaggtagcgaaattccttgtcgggtaagttccgacctgcacgaatggcgtaacgacttccccactgtctcgaccaggagctcggcgaaattgcagtacgagtaaagatgctcgttaagcgcagaaggacgaaaagaccccgggacctttactataccttggtattggcattcggtgtggattgtgtagcataggcgggaggccgagaggcgcggtcgccagaccgcgcggagccgtaaggtgaaataccgctctgttcgcattggatgtctaacctcgaacagtcatcctgttcagggacagtgcctggcgggtagtttaactggggcggttgcctcccaaagagtaacggaggcgcccaaaggtccgctcagcccggttggcaatcgggtggcgagtgcaagtgcacaagcgggcttgactgcgaggacgacggtccgagcagggacgaaagtcgggactagtgatccggtgccggtgtacggacgcggcatcgctcaacggataaaaggtaccccggggataacaggctgatcattcccaagagtccatatcgacgggatggtttggcacctcgatgtcggctcgtcgcatcctggggctggagcaggtcccaagggttcggctgttcgccgattaaagcggcacgcgagctgggttcagaacgtcgtgagacagtttggtctctatcctctgcgctcgttggaatgctgaggaggcctgcccatagtacgagaggacctgggtggacgaacctctggtatgccggttgtcacgccagtggcacggccggttggctacgttcggaagggataaccgctgaaagcatctaagcgggaagcctgctccaagataagcattccgtggaaccttcgagttcctgtagtccccatgcagaacacgtggtcgataggccggacgtggaagccccgcgaggggtggagccgaccggtactaacggacgaaaggcaacactaa

SEQ ID NO: 1920 - DNA, 2841 bp, Bifidobacterium longum
ttggctcactatcgttcgatcgttcgtacctcgcctgcgaacagcctactgggctgtttactgtacagttcggcttgtcatgcaacgtgcataaactttggccttatgactgaaggcaaatccatcatcaacgccaacctcaccccgctgcccgacaaggtcggcgtggacggacttgaggacaagtggcgcaccgtctgggatgaagacggcacctacaaattccgcaacacccgcgaccgcaaggccgtctactccatcgacaccccgccgcccaccgtctccggttcgctgcacgtgggtcacgtgttctcttacacgcacaccgatgtgattgcgcgctacaagcgcatgcgcggctacgacgtgttctacccgatgggttgggatgacaacggcctgcctaccgagcgccgcgtgcagaactactatggcgtgcgcgtggacgtgtctctgccttacgacccggacttcaagccgccgtttgaaggcactgatggcaagaagattgacgccaaggatcaggtgccgatttcccgcaagaacttcatcgagctgtgcgagcgtctgactgctcaggatgagaagctgtttgaggccctgtggcgcaagctgggtctgtccatcgactggtcgcagacctaccacaccatcggtcagcacccgcagcgtgtggcccagaaggccttcctgcgcaacctcgcccgtggcgaggcctaccagcaggacgcccccggcctgtgggatgtgaccttccagaccgccgtggcccaggccgagctcgaatcgcgcgaataccccggcttctaccacaaggtggccttccgctttgaggacggcaccccgatctacatcgagaccacccgccccgaactgctggcggcctgcacctcgctgatcgccaacccgaacgacgaacgctacaagcagtacttcggccagtacgtctactcccctctgttcaaggtcaaggtgccgattctggcgcacccggccgccgaaatggacaagggtgccggtatcgccatgtgctgtacgttcggtgatgtaaccgacgtcgagtggtggcgcgacctgaagctgcccacccgcccgatcatccagcgcaacggccgtatcgtgatggataccccggactggatcgaggacccggccggccgcgaggtctttgccgaaaccgctggcaagaccacgttctccgcccgcaagatcatcgtcgacaagctgcgcgagtccggcgatctggacggcgagccgaccccgaccaagcgtatgacgaacttctacgagaagggcgacaagccgctcgagatcgtcacctcccgccagtggtatttgaagaacggcggtaccgacgccaagctgaacgccgagcttatcgagcgtggcaaggaactcgagttccaccccgacttcatgcgcgtgcgttatgagaactgggtgcacggcctgaacggcgactggctgatctcccgtcagcgcttcttcggcgtcccgttcccgctgtggtacccggtgaacgcttccggcgagccggattacgatcacccgatcactccgtccgaggatcgtctgccgatcgacccgaccatcgacgtgccggagggctacgacgagtcccagcgtgatgtgcccggtggtttcaccgccgaaaaggacatcatggacacctgggccacctcttcgctgaccccgcagatcgtgacccactgggccgagccggacgaggcctccaaggccctgttcgcttccaccttcccgatggacctgcgcccgcagggtcaggacatcatccgcacctggctgttctcgactgtggaccgcgcgcacttggagaacaagtgcctgccgtgggcccatgccacgctgtccggctggattctggaccccgaccacaagaagatgtcgaagtccaagggcaacgtcgtggtgccgaacgagccgatcgagaagttcggcgcggacgccgtgcgttactgggccgccgccgctcgcctaggcctcgatgccacgtacgacatcggccagatgaagattggccgtcgactggccatcaagctgctgaacgccaccaagttcgcgctggccatcggccgtgaggacgagaaccatcacgtgggcgctgccgccgaggccgcgtggaacccggccgatgtgaccgaaccgctggatcgcgccgctatggccaagctggctttggtggtgcgtcaggccaccgaggcgctggaatcctacgagcattccaaggcgctggaagtcatcgagtcctacttctggcagttctgcgacgactacatcgagctggtcaagaaccgcgcctatggcactccggacgagcacggcaatgtgccgtccgagaaggctgtgaagtccgcccgcaccgctctgggtctgggcctggacgccttcgcacgtctgctggccccgtacctgccgtacgccaccgaggaagtgtggagctggatgcacgccggttccggttccgtgcatcgcgccgcctggccggtcgtggacccgtatgtcgaggccgccaccggtgcttcccccgagctgctgacttgggccggcaaggccgtggagcagctgcgtaagatcaagtccgaggccaaggtctccatgaagaccccaatcctgtctgtggcactgtccgctgcttcggaaggcgtggaagcgattcacgccgccttgggcgatatcgcgcaggccggtcgcgtggtcggcaagttcgacttggtggccaagcacgccgaggaatccgccgccgaaggcacgcccgaaaccgaggtcgccgtcgaagccagcgagctcggtgagccgccagctaagaagccaaagcactga

SEQ ID NO: 1921 - DNA, 2046 bp, Bifidobacterium longum
gtgcggctaccatatattgtcatgacgtcaccagccaccgcgaagcttgccgccgtatccagccgccagtcccacccgcatcttgcgcgcgcgggcgctgccgcgcgctggacactggccgtgctggccggcctgtggcttgcactgtgcacggcggtcggcccgctgtactgggacgaggagaacggcaccctcgcccattggaactgggccaataccgcaatattcgtcgtgtcattcctgatatatctcggaatcatcacgctgatggtgcgattcgcagcaggccagcgcatactgccgagggctatcggcgagcgactacgtcaacatcagcggaatagcgaaacatcacggcccgccgccgatcagcaggccagccaaccagccaagacccgtcgtaccgttcgcgctatcgtcacgtccaccgtcactgttctggaccgctggatcacacgcggcacgaaccggttctggaagcttatgctggtgttttttgtcggctggctctgggtgccgaccactctgctggccgcattcggtgcggacctccgctcacagatccgtgaattcagctgggcctggaaccagtggaccggcctgaaacagccctatatcggcttcttctccttcgtgccgatggacatctaccccactgcgcactacatgtggccgtccgatcccacgtatctgaccgaccagcacaatgtggtactcactgtgttctatggcgcgatggtcacgtttgcgaggcatctgaccggctcaaacgatgccggtatcgtgacgttggctgccctgcagacgctgttcgccgtgttctgctgcgctgccgccgccaatcgattcctgaaccggccttggataggaaaaacggcaacggattccgccgctcccccacaggccggaggattggccagattcctgattctgctgttcttcatggtctgcccgctggccgtgttttccactatctccatcaccaaatcgccgctgttcgcgttctcgttcgtctggtggttcagcgtctggtatgaactcgtccagacctggcaccccgccggcacccgcaaacatcctcagacccctgccatcgccacgcccgtccacttgccgcgtcacagtttcatcgcctttatcctggccacgtcggtaatgctgatttccgcgaaatatgcgtggtacatcatcgccctacaaatcgtgctggctctgatcgccgaccgcaagcgctgggcgacttacgtcgtggcgctgctcatccccaccgtactgattcacggcggcatctccttcgccatctcctctggcgcgatcatcggcggcgacccaatcgaaagccgcggcgtacagctgcaaatgatcgcccgcgtggcccagcgcaatccggacggcatttcagacgaagccaaaaagaacctcgcgcccgtcttcaatctcgatcagatggccgacgcttactcccagcaggacgccgacccggtgaaatcctccggcattcaggccaagaaggtcagctacaagtggcgcacggtgacgcccgaggatatgaccaatttcaacaaggcatggttcgaaatcgtcaaggacaatccaatcatcgcgctggatgcgttgctggccaaatgcttcggatacttcaatgtgaacgatcagccgtacgtatcgatggattattacgtgaccagcgattacgtgcagaaaaactccacatggatcaaggattacaaccatgactggcgtgagcacatcgccggcttcactcgcgtatggggcggtattcccgtactcggctggcctacgcacggcaatttctacgtggtgatgacattgctgatcggcgcggccgaggtgattcgccgacgttggctcaccctcatgacccatattccgctgctactgctgatgggcgtgatgatcaccgcgccggccaataatttcgagcggcacatgttgccggttgcgtttgtattcggattcgtggtgctgacgtattggcgagagtctttggctgaaaggcaacgccaatcagcgacgctacactag

SEQ ID NO: 1922 - DNA, 1359 bp, Bifidobacterium longum
gtgcaacttcaccacttatgtaggaaaggccttgcaatggtcgattattcgccggctctgatgaccgacatgtatgaatacacgatgctcgacgccgctctgaaagacggtaccgccgaccgcaagtgcgtgttcgaggtgttcacgcgtcacttgcccgaaggccgtcgctatggcgtggtggccggcaccggccgcattctggatgcgctggaacatttccacttggatgaagcggatctgaagttcctggccgaccgtcacgtggtaagccccgagaccattaagtggctggagaacttccacttttccggtacgattcgcggttaccgcgaaggtgagatgttcttcccgaactccccgattttgcaggtcgaaggcacgttcggcgaatgcacgctactggagacgttgattctatccgtgctgaactacgattccgcagtggcctccgccgcctcacgtatggcgtcggcagccaaggatcgtccttgcatggatatgggcggacgccgcactaacgagtgggccgccgtggccgccgctcgagctgccgtagtgggcggattcaagggtaccgccaatctgctggccgcccagctgtatggtctgaaggccattggcaccgccgcgcattgcttcacgttggtgcatgattccgagcgtgacgcctttgaatcgcagatcgaggcattgggcaagaacaccacgctgctggtggacacctacaacatcgaggaagccgtgaaaaccgccgtcgaagtggccggtcccgaactgggtggcgtgcgcatcgactccggcgacttggccgccatggcccagcgtgtgcgcaaccagctggacgccctgggtgccacgaacaccaccattaccgtgaccaacgatttggatgagtacgcgctcgccgcattgcagaccgcgccggtcgactcctatggcgtgggcaccatgctggtcaccggctccggcgctcccacttgtgcgatggtgtacaagctcaccgagcgtgaaggcgctgacggcacgatggttccggtcatgaagaagtccaaggataaggccacagtgcccggtcgcaagttggcattccgctcctacgaatacgcgctagccgaagccgaacacgtgatttccggctcggaagagaagctggccggtttcacgcccgaaccgacgtggaagaacctgctggtcgatttcgtggaccacggccatatcgatgcgcagtggcagggccatgacgccatcatggccgcccacgactaccacgccaaggcgttgtccgaactgcccatcaccgcgcagagcctcatgaagggcgagccagtgattcctacggagactcaggttctctga

SEQ ID NO: 1923 - DNA, 1812 bp, Bifidobacterium longum
atggttcgtcgcgcccaggctgctcttcggtccgttgaacacaccagcgtgaggcagctgcgagttctggctgcgattgtatttctgttcgccatggtcatcgccactgtggctcctgcagtcacggctccgatggccttcgccgacagcagcaccagctcgtccagttcatcaagctcgtccagcgttgactacgccacctgggccgaagtctccaaggcgatggacaagcagctgaacagcggtcttaagacgtacaaggatggcaacaccgctggcgccacctccgatttcatgggcgcgtacaacaagatttacgtggcctccaacttcaccgcggtcgtgcacgacaccattggcgcggacaagcagcttgcccaacagcaggcattccaaagcgttcagaatctttcctacacgcctggcaacgacgatcaactgactcagcagattgatgcgttgaccgccgatcttgacgccacggcccagcagctcgacaccaacgccgatctcgccaagccgaaggcgtacgccgaagcgctgcaggcgcagctggccaaagagcgcaaggagctcgacgccaagaaaaagaagaacccaggcaagggcaatcgttcatggaccgacgtggccaacgaaatgaccccgattctcgacaatgcatacaaagcttacgaaaagggtgatggtgccaagggcgccacgctcgtgaacaacgcgtactaccagtattacgagaagctcggcttcgaaaagaacgtgatgaacgccatcagcggcaaccgcgtctcgcaggtggaataccagttcaagatgtgccgcaagtccatgaacgccggcgcatccctgaaagacaccaagaagctgatcgacgacctcaaggccatgctgatcaaggacgccggcattcttgacggtggtgccgccgataaggaagacggtttcaccaagctggtcaccagctcctccggccaggcgttcctcgtgcttatccgtgagggtcttgaagctctgctggtggttgcagccatcgtcgcctacttggtcaagtccgataacaagcgcttcgtcaagtggatttacttgggtgtgctcgtcggtctgctcggcgccggcttggtggctgtgatcttcgtgttcgccttcggcggctccggcccgattcaggagatcatggaaggcacctgcgcactgatcgccatgggcatgctgctgtggacgagtaactggatgctgaacaagtccagcgtggaagcgtggaaccgttacattcgcaagaagaccgaggctgctgtggctgatgccgaagccgccgcaagtgccgacaacgtgacgttgaaaaccgtggtctcgctggctatgctgagcttcctcgccgtgttccgtgaaggcgctgaaaccgtgatcttctacgagtccatctacacgatgagccgcgatactcgcggtatgtggatcggtggtctgaccgccgcggtggtgcttgtcggcatcttcctgctcttccgcttcacctccgtgaagattccgattggtccgttcttcctggtcacttcgattctgatgtctgtgctggtggtggtgttcgccggcggcggcgtccactcgctgatcgagggcgacttgctgcccgccttctacctgaacggtgtgccgacgaacgattggcttggcctctacccgtacgtcgaatgcctagtggcgcaggccatcgcagccgttgcggttatcgcgctgttcgtggtcggcttcatcaagcagcgcaagctgaaggcgcaggctactgccgaggtcccggccgtgaaggcgtag

SEQ ID NO: 1924 - DNA, 1380 bp, Bifidobacterium longum
gtggagtgcatgactactgcaatgggctactcatctaccggccgtccaccgaccgccgcttcactggcctcgtctggctttgagccgggtcaaggcactttcgcgcccgatcggggcgccatcaatctgccgaatgagcctcgccctatcgatcagctgcctgcacgcgccgctgaaaccaccgcgcaaaatccgtggccggtaagcgtgctgagccagaagttctacggtgccgtggaacgatggccgtccgcgtgggtcaccggccagatcacgcagatcaatacccgtcgcgccggctcggcctacatcacgctgcgcgacgacttcgaggatatcgccatggaagtcaatggcttcggcaggttcgcggccgcagccagccagttcgttcagggcgaccgcgtggtgattcacggcaaaccgaacctgtggatgaagcgcacttcgctgtcgttgcgcggggacacgattctcaaggtcggagccggtggcagcctcaaggccatgatcgacgaattgcgcaagcagcttaagggcgagggcctgttcgatgccgatcacaaactgcctctcccggagtttccgaagactattggcctgatttgcgcacctcaggcacgtgcggaaggcgatgtgatcaccaatgtgaaccttcgttggccttccgtaaccttcaaggtggtccatgtgcatgttcagggcgagcaatgcccggccgaggtggttcaggccattgcacaactcgatgccgacccgagcgtggatgtgatcatcgtggcccgtggcggcggctcgtttgaggatctcatcggtttctcggatgagcgtgtggttcgtgcggcgtatgcctgcactacaccattaatctcctccatcgggcatgaggatgactggacattgctggatctggtcgccgatctgcgcgcctccacccctaccgatgcggccaagcgcgtggtgccggatgtgcgtgagcagtcgcagctcatcgaaggtgccatcgaccgtatgcgactgcgggtccgttcgcgcgtggagaacgagattcgacttatcgagggatatgcgaaccgcccgagcctgacacagccgcacaccatgcttgagcctcatcagcgcttaattgacgactcgttgcaacggctcgatatcgggctgcgacgcatcgtggacgatgcccagctcaccgtcgagcgagctcacgcctcactgaccgcactcagcccgcaatccacgttgaaccgaggctatgcggtggtgcagtccgccgatggccacgtactagacgatgcttcgcaggtaagccctggggatggcatcaccgtcaccttgaagaagggtgtcattaccgcaaccaccacatccgcaaccgcgtga

SEQ ID NO: 1925 - DNA, 1575 bp, Bifidobacterium longum
atggtgaattgcggattctgggctgaatccaccgctagactgaaaaccatgcagcacagcaagcgggacaatacatggtccaagtgggggatttttctcggagtcgccgtggcactcggcgcactcgtggttgtgggatggacgttcatgcaaaaccggttccagccgggatcatccctcgatgccggtgtgaccattggcatcgacgatatgccgcaatccttggatattcggtccgattcctctgcggcagccgaacgcctgctcgtcgacaatgtgtatgagacattagtgaccgtcgatcaagacaacaagcttcagccgggactggcgacaagctggaagacttccgatgacggactgaccgtcaccctgacactgcaatcgggcgtcaccttctcgaacggccatacgttggacgcctcggacgccgtgtggtcgttgcaacagaacgtgaccaacaaggtggcggacgtcgacgaattgggcgatctggcgtcggtcgccaatccgaacgccaccacggtggtcattacgcttgccaagcccaatccgacgctgctgcgagcgctgtccggcagactcggcattgtctacgattccgagtcgtccagtgccgattatcaacgcaaggccataggttccggaccattcaccgtggccgatttccagcctggccattccctgaagctggcgcgcagcgatacctaccatggcaccaaagcggccagcaatgtcgttgaatttatgcaatactccgacgccgatgcgctcagcaaggccctgaccgacggcagtctcgatatggcggcaccggtttcggcttcgacggccaccggtttgaacggcaaggatggcctgaccgtcaaggagggggccactacggataaggtgctgctggcctacaacaacggcaccgattcgctgctctccgacgaacaggcgcgtaaagccttccgctatcaaatcgacgcagccggcatcgcctccgcccaacccgacgcagccggagcattgggcggccccatcagcctgctggaacccggatacgaagatttgaccggactgtacccgcatgacgaaaaccaagctgggcagatgttctcctactttggtgcgcaatacctgactacggtgaatctggtggttcccgaagaataccggtcgttggccgaaaccatcaagcagcagatcgagcggcagccgcgccccacggtgaaccttgaagtgctctccgatgaggattatgccaaacgaatcaaggacggcaaatgggaactgaccgtgatgagcatggacggcacggatgatgccggcatattcgccgaccccgattccatgttccattacgaccataccgaagcgcaacaggcctatgcggatgctcgcgccgccactaatgacgccgattatgaggcacgaatgaaggcgtacgcccggctgatcagcgaggatgcggccagtgattggctgtatacccgcaaatgcttcactgtggcgtccaccaaggtctccggctacccgacctcgatgatcaatcgccgcatgccgctggccgggttgacggtgaagtag

SEQ ID NO: 1926 - DNA, 4815 bp, Flavonifractor sp.
gacgagctgctggcggagcaggaagcggtgttggagcagatttcggggctgactggggaggacgagagcattgaggccaggcactatgtcacggcggtcaatgccatgtctctgacccttccttggggcattgcggatcaggtggaacagctggacggagtggctcaagtgtatgcggccgcccgtttttcccctgcggagagcacgcaggccgtccaaacggtggagcagaccatttttgccgggggcatggtgaatgtagagacagcttgggaccaggggtacgacggagcgggtacagtaattgccgtcatcgacacaggcttggatttggagcatcctgcctttgacgttgagatggatggggccagcctggccctagggcccagcgaagtatcagaggtgctggaagaacttcacgcctatggagaatatgcggatctgacggcagaggatgtctcacacgggactaaggtaccctttgcatttaactatgcagaccactccctggacgtatcccacagtggggacagcgagggagatcatggcacccacgtggcagggattgtggctgcggcgggagaagaagggcagagcatgggaatcgctcccggagcccagctgctggtgatgaaggtgtttggagccagccaggacagcgcgtctgaggcagtgctgctagccgcactggaggatgcgattctattaggggcggatgtcataaacctgagcctgggtatggcggtaggcttttcctccggaggatacgcctacactcaggccattgagaacgccgcggaggccgggatcgtggtgtgtgccgccgctggaaacgataccagctctacggtgggcaacgccggagggaccgacctaggcaccacgagcaacattgacatcggcgcggtgagcgaccccagttccttgacacaggtgatgtccattgccagcgtcaacaataattgggtgctggcgcaagggttttttaccagcccgtcagatggagaacctttgtttatcccagtcagcgacagcggcgcccaattcgggcatcaatcgtttgagaccttagctggcagggataacgaagaaaagggtggatacgaatatgtagtggtccccggtgtgggccgctcggaggacttttccagggtggacgctatgggtcggattgccttgatctggcggggagagattgcgttttcggaaaagtgcgacaatgcattcgccgcaggagccatagctgttatcgtgtgtaatacagaaagtgagtttgtcaccatggatttgagtggcactcaggtggataattccctgccttgcgtgatgatctcccaagaggatggacaagttctcgttgaagaggccggagaggatgggatgggagctttgaccgtgtcagctcaatggcagacggtgcaggcggaggatggcggacagctcagcagcttttccagttgggggggcctgcccgatctgacgctcaagcccgacttggctgcggtgggaggcaatgtctactccaccatggacggcggcgcctacggcaccatgagcggcacttccatggcggctccccaggcgtctggtatggcggcgctgctgctacagcacctgcgagagacttatgaaatgaccggaccggaggcgcgggaacgggtacagaccctgctgatgaacaccgccgcgcctgtgctccagtccgacggggtggagtattcgcccagaaagcagggggcagggttggccaatgtgggccatgcggtgactacgccggtatggctgaccgtaaacggctctgagctgccgaaagcagaattgggagacgatccggaggagacagggatttatgagttttcctttaccgcttacaacgagtccgataccgctcagagctattgggcggaggcgtccctcctgacggagacagcggggaacggactcatgctccagaaggccagaaagctggatgccgaggtgacctttgcttctgttggcgggactcccggcggcggggacgcagcctctaccgccgtattggtgacggtacccgcccaaggggaaacccaagtgactgtgcgcataaaattgactgaggcggagaagaaagcgctccgggagacgtttgaaaatggaatttatgtggagggctatgtccacctgcgctccacacaggaggagggcgtggacctgtccatcccaattctggctttcttcggagactggagccgtgcgcccctgttcgacccaatgtatattgcccagttagagtctgccgccaatgagaacggaaccctgacctccaacagcccctatccctttgaaatcgtgaccggcgaaaacagctatttgggaatgaaccctgtaggtcaggataccgcatacattccggagcggtccaatgccctgaacgccacgggagaagagggcggcatggtgtcggatctgatcctggacctgctgcgcagcgcccggcatgttacggtggagttcctagacagcgcgggccgcacactgtatcaaagccaagcggactatgtggcaaaatcttgttaccaggacgcttatcagcagatgattccagcggtatggagtctgtacgacgaggacttttcctttgtgccaggggactatggcctttctgacggcagcaccttcaccctccggattacgggggagaaggacaccgggggaagctttgccaaggagacgatagaatttccctgttatgtggacggccgcgcgccccaggtgcggtcggttgcggtgcgtgctggagaagaggcggacggacggcggctgctggatgtgacggtatgggacaactattatgtagcaggtgttatggtgctctctgctgacggagagcgggagctggatgtccgggtgctggaccagaagatccggggcgcttccaccaccttgaccttggatgtgaccgatatcgtgcctatggccggcgggacgctgcagattggagtgatggactacgcccaaaacctgacgctgcacgaagtagatgtgctgctggacggagaaaccaccctgttgccagaggacaccttttacgcatacggtgcggattatgatgcctccggctggtacaccgtccgggagggggcggaggagctgccggacggtttcctggattacttgggttcggtgtgcgcggctgaatcggtgggcagctacctcttcgctgccggcagtcagaacaccggatggctgtatgcgatcgacaccaccacctttcagccggtttatgtatgtgaccttgggctgacccccttgtctgacgaggtgctggacctggcgtatagtcaggcggacggggcgctttatgctctggtgcggaagggggcggaataccagctgctgcgggtggatctgtctggtgaaacggcggaactggccttaacggtcaacagggagctgataggggatctcgagcggccctatgccttagcctgcgccccagatggaacactgatgcttctggtgggcatcggccggccggaagcgctggccctatgtgcggtggacccggacacagggaccgtagaccggctggaccagttggggctggaactggaggagagcgttttgtccgctgtggcggaccaggagacgggagaggtatacttcacctattaccgggaggattggagccatacagagacaacgccaaaggtggagtccggcttgtatgtctggaggccggagggggacggcgggaggctggacaagctccgggacctgccggcggagccgtatgacgctttggtactcaccgggaatgccagcgcggaattccccccggacggcgaggcgggcaaggtgatattgtcccatcacagcaggcacctttcggcggggaggagcttccagctgacggttcaggatatccgtccctggtatgtggatggcggagactatgagatagcgtattccagcgcggatccttctgtagcccaggtggatcaaaagggcaacgtcacggcccgtggggcggggagcacggagatcaccgtcaccctcacccaaccggccggccggtccgtgtcggcggcctgccgggtttatgtggagaaacccaatgacctgatggccctcctggacgggacctgggtgaccctggacgggcagaccttgcgtccgtcagacggtgcgcggctcccctctgagggagtgtcggcggcctatgccgccggagctggtccggaaggacaggatgtgatctttctcttggcccccagcggatgggacgaggtggtggactgccccgtttacagcctggacagctatgatgccgaaagcttggagctgctggaacagcgggagctgtcccgcagctggtatatccggccggaacagttgccggaacatggcttccgagacatggcttatgatccggtgagcggctatttgacggcagtgtctgaccagctgatggtttccattgacttgaaccaggggcgtttttacatggcgggggacgcatcccgccaactgggcggcgcggaactgctgggcattgcctttgacagcgatgggaacggctggtatgcagacagcgccggggctgtgggaaaggtgatgtcgtatttgggcgcggtggagttggagccgtccggccttgtccttcccatcggccaggacccggggaaacgctctggtatggagtatgacgagctgtccggacggctgtggattgccgccggggaacacttgtatggcatccaggcatcggaaggcttccggctgtttcggtctgcttccgtgcagggagagttgtcctgcctgcttattcgacac

SEQ ID NO: 1927 - DNA, 3672 bp, Flavonifractor sp.
acccgaaagcagcccaccgccatcggggaactggaattggatatgggaaacgtcctgatcgaaggggacgtattcaatgtggagcatcgggaactgccccgccggaaggcgtgggtggtctgttttgacgtgaccgattatacgggttctatccgcattagtcagttcatggacggagatgtggcaaagccgattattaaagccatcaaaagcggtctgcatgttcagatccagggacggctgaccgtgagccggttcgagagcgacatggtgttagagccctatggcatcaacgaactaccaaaaccggagggtcgcaaagacaacgctccggaaaagcgcattgagttgcacctacataccaagatgtctatgatggacgccctgtgcgacaccaaggaagtggtcaagcgggctatcagctggggacatccggccattgctatcacggatcacggcgtggtgcagtcttttccggatgcctataacgcctcaggaaagggagagaaaatcaagatcatctacggtgtggaagcgtactttcagaacgacgtggatgagcgggtggccgtccacggaaccggagatcgcgggctggaagaggagtatattgccttcgatttagagaccaccggcctggacaagcggacggatcagatcatcgagattggtgcggttcttatccggggcgggcaagtggcggataccttttctagctttgcccagccgggacatcccctcagcgccaagaccgtgtccctgaccagcatcacagatgagatgcttctaggcgctcccagcccggaggaagcggtggaggcatttctggactgggcggggaaccgtcccctggtggcccacaacgctgagttcgacgtgggctttgtgcgggagtactgcaggcgaagcggccgcccctttgacccgctgtggacggacacactgattctggcccagtatctgtgcccggaactgaacaaccataaattagacaccgtggccagccatttggaactgccgccctttcatcaccaccgggcctttgacgatgccgaagtatgcggccagatcttctggcacctgctgcccaggctgcgccgggcgggggtggagcggttggcccaagtgaacccggcgctggcgggaatgaaaaaagggggccggggccgccgtaccgcttatcatctgattctgctggccaaaaaccagacaggcctgcgcaatctctataagttggtttccaaaagccatttggaacactacaaccgatttcccatcatgccgaaatctctgatcaatgaaaaccgggaggggctgattatcggttctgcctgcgaggcgggagaattattccgggctatcgtggacggtaaagacgatcaggaactgctgcgaatcgcctcttggtatgactatctggaaatacaacctctgtccaataacgcctatatgctccggccggacaaagagggcaagtccatcgcccgtgactgggaggaccttcgaaatttcaaccgtaaagtagtggaactggccaactggctgggaaaaccggtgtgcgccacgggagatgtccactttatggacccccaggacgagatctatcggcacatcctgctggccgccaaggagtttgacgacgcggacagcagcaatcccctgtatttccggaccacggacgagatgctggaggaatttcaatatctggggacggagacggcccgccgggtagtcatcgacgatccagccaagatcgccagctgggtggacaatgtgcgcccactgcctcagggcctgttcacgcccaagatcgaaaactccgaggggcagttgcgggacttggtatggggcaaggccaaacggctatacggggagaacccgccccagattgtggtggaccgcatcaatgcagagctcaaggatatcattggctgccactacgatgtgatttatatgtccgcccagaagctggtgcagaactccctggagcacggttatctggtgggctccaggggctcggtgggttcgtccctggtggcttttatgtccggtatcacggaggtgaactccctgcctgcccactatcgctgcccaaactgtaagcactccgactttgattacgcccaagatcctgctcatcccttcggatgcggagcggatatgccggacgcgaagtgtccggtgtgcggtgcggactacgagaaggacggcttcaacattccttttgagaccttcctgggctttggcggcgacaaggtgcccgacatcgacctgaacttctctggagagtatcaggccaacgcccatcgctatacctttgaactgtttggcagcgaccatgtattccgggctggcaccatcggtaccgtggcggaaaagaccgccatcggatatgtgaaaaagtacatggagcgggtgggacgggagaacgtgccctttgcggaggtgctgcgtctggcccgggggtgtacgggggtcaaacgtaccaccggacagcaccctggcggcatggtggtcatcccccaggacaaggaaatctacgatttctgcccggtgcagcacccggcggacaacaaggactcggatatcatcaccactcattttgaataccactccatggagtccaatctgttgaagctggatatgctgggccacgacgatccgtccatgatccgtatgcttcaggacctcaccggagtggacccacagaagattcggctggacgatccgggtactatgagcctgtttattacctcggaagcgctgggctttacagacgacccgctgcttgggccaacgggagctgtggccatcccagagtttaacaccaaatttacccgaggtgtgctggaggaaacccacccaacccaggtggacacgctgctgcggatctccggctttacccacggcacggacgtgtggctgggcaatgcccgcgacctgatcacttctgggacagcaaatacccaggagtgcgtggggtgccgggacgacattatgatttatttgatctccatgggctttgcgccaaagcgggcctttaagatcatggaatctgtccgaaagggcaggggcctgcccgaaggggcggaggaagagatgaaggcccagaaggtgccggaatggtatatcgagtcctgcaagaagattgcatacctgttccccaaggcccatgctgtggcctacgtgatgatggccctgcgcatcgcctggttcaaggtccaccgtccgctggccttttatgcggcctacttttccatccgagcaaaggcttttgatgaaagatttatgtgccgggggatggaagttgtcaagcagaaaatccgagagatcaacgacaaaaagaatgccaaggatagatcggatcggcccactgcggtggaggaggatatgctggtcactctggaagtgtgctatgagttctacctgcgagggttcacttttgccagaatggacattcagcgatctcatgcggtcaattttctggtggacgaggaacgcggtgccctgatcccgccgtttacctctgtggcaggactgggcgagacggtgggctgggatatcatggaaaagcgaaagggaaaaacctttatctccatcgaagaattttccttggtttgtacgaaggtatccagcacccatctggcgcagctcaaagaggcgggagccttt

SEQ ID NO: 1928 - DNA, 2136 bp, Flavonifractor sp.
atgcaaagcaatcgctatggtggaaagcgggtataccgcgggcgtaaaagcagcgcgggatctgatagcactatttttctgaaagctgtgggacgggtggcttttttcccgctactgttcgtctacctggagctggttcttcacatcgccatgggggcgaacctgaaatatttcatcatctacacgctgttcgccctatccttgggctgcctgttcagcgccctcaccatgcccttcaagcggaaggtgaaccgggtactggtaaaggtgctgtcggtggtgatctccctcatctatatcattgagatgatcgccaagaagatcttgcagagctactatcctttcagcatattgggtacggcggcggataatcacctgactgactacacggaagtcattgtctctacggtactgcgcaacattccccttatcttgttgatgttgctgcctgccattctggtcatcgccgttggaaaccgcatcctgctgtttccaaggacagacgtacgctttgccggggcaatggtaggggccatggtggtgctccacctgctggctctggggacggtccatctgccctggggcggggacctgacccccgcccagctatataaggtggacaccaatttggacgatcaggtggagcagttgggactgctcaccatgctccggctggatatcaagcatatggtcgtacccgcgggcacacttctggatgatgactttgacaacctgccggcgggtaacccctcggatcagccctccaccccggcagacagcgacggtccggagatcagccccactccggagatcgacacctcccccaatgtgatggacgtagacttggaggcggtggccaacagcacgaacaacgacaatatcaagtggctggccaactacttcaacagtgtgactccaaccaacaagaacgagtacaccggcatgtttgaaggatacaacgtgattctttttgtattggagggcttctctggctacgcgctggacccagagcttactcccacgctgtggaaaatgtctcatgaggggtttgtatttaacaactactacaccgccctccactttaccagcacttccaacggtgagtgccagaccctgctgggcttgtatcccaaaaacggaagccccatcaccatgaagcgcaccggcgagattggtaccaactgctacttctccttggctcagcagctgggacgcgctgggtataatgtactgggctatcacgacaaccaagatatgtacggccgcaatgcctcccataccaacctgggatacaactggaaatactacacccatggcctgcaatgtgaggaaaatgccgatggaacggaccggctgtggccccagcgtgacaagtatatgattgaggtgagcgtggacgactatatccacgatgatactcccttccatgtgtattaccttacggtcagcggacacaccaattacggctggaatcgggtggcaactcagtaccgggacctggtatctgatctgccatacagtgaaaagacccaggcttatgtagcggcggctgccatcgaggtggaccgtgctatgcagacgctgctggatgagctggaagcggcaggcaagctggacaacaccctcatcgtagctactggggaccacatcccctatgcggatgttgacgtgctggaagagttagcgggcaagagcttcggcagttcggaggacctgtccaatatcaaggaatccaacatagacttcgatgtgtataagaatactctcatcatgtggtcggccagcatggatgagccggtggaggtggacaaggtgtgctgccaggtagatattctgcctacagtatccaacctgctgggcctggagtatgactcccggatgctggacggaagcgacatcttgtcagacagcgaggggcttgtggtgttttcctcccggtgctggaagtctgaccggggcttctacaatcgttacacccaggaattcacccctgccgagggcgtcaccatgaccccagacgagcaggaggaatacgtctcagccatgaagaagctggtgggctacaagctggacagcacagagcttatcgtggaaaacgatttttatgactatgtgttcaaccaattccaaggatag

SEQ ID NO: 1929 - DNA, 3585 bp, Flavonifractor sp.
gtgcatccgggccacagcgcagcgacgttagcgcaggcccatttgtcccagtttccgcaggaggggaaaagccagccgcccggacgggttaaaaagctggctggcatcggtcaaagggacgcagaaaggagaaagaagatggcctttacacaccttcatgtgcatacggaatactccctgttggatggcgcctgccgtatcagtgagctggtcaagcgggtcaaagaattgggacaagatgcagtggccatcacagaccacggagtaatgtacggagtcattgatttctataaggcgtgcaaggctgccggagtcaagccgatcattggctgcgaggtctacgtagcccagcgcaagcgcacagaccgggttcatgagcgggatgcggagtcccgtcacctggttctgctgtgcaagaatgagacaggctatcgcaacttgagctacatggtgtccatggggtttttagagggattttatatcaagccccgtatcgatatggaactgctccgcgcccacagcgagggcctgatcgccctgtccgcctgcttggcgggggagatcccccgcctgctacggaatggggactacgaaggggcaaaggcccacgccctggagatgcaggagctgtttggggaggacagctattatctggagctccaagaccacggcctgccagaacaaaagcagatcgtagccggtatcctccggctccatgaggagacggggatccccttggtgtgcaccaacgacgcccattacctcacccgtgaggatgcggagatgcaggatgccctcatgtgtgtccagatgggaaaactcatggaggacgacagccggatgcgctttgagactcaggagttttacatcaagtcggaggaggagatgcgccgcctgttccctgattgcccggacgcctttgacaacactgtgaagatcgcggatatgtgtcatgtggacttccagtttggcgtccatcacctgccggaattcaagcttccggagggagagaccgacggagacgcctattttgagaagctgtgccgggagggctttgcccggcgttatccccagggcggccaagagcttgtggaccggctggagatggagatgggcgtgattcggcagatggggtttgtggattacttcctcattgtgtctgacttcattggatacgccaaatccaacgggattcccgtggggccaggccggggatctgccgcaggatctatggtagcctactgcctgaacatcaccgacatcgaccccatcaaatactccctctatttcgagcggtttctgaacccagagcgggtgaccatgccggatattgacattgacttctgtattcgccggagacaggaggtcattgactatgtttcccggaagtatggggaggaccacgtggcccagatcgtcacctttggcacgatgaaggccaaggctgctattcgagatgtgggccgggtgctgaacatgccctatgccgaggtggacaacatcgcaaagcaagtgccctttgatttgaaaatgacattggacaaggcgctgacgctgtccaaaggcttttctgatctctacaagggagatgagcgggtgcgtcggctggtggacttggcccgaaaggtggaggggatgccccgcaatgcctccacccacgctgcgggcgtggtgatcacccgaaagccggtttatgagtatgttcccctggcgaccaacgacgatttggtggtcacccaatacaccatgacgaccctggaagagctgggcctgttgaagatggacttcctgggcctgcggaacctgacgattctggatgacgcggtgaagatggtccgacagcatgagccctgtttccggctagatcagattccggagaacgacccggaggtatttcagatgctgtctgacgggcggacgtctggcgtgttccagatggagtcggcggggatgaccggggtatgtgttgggctgaagccccagaatattgaggacatcaccgccatcattgccctgtaccgcccaggcccgatggactccatcccgcgctttattgcctgcaagcacaatccagagctggtccgctacaaacatccgctgttggagccgattttgtccattacctatggctgtatcgtctaccaggagcaggtgatcgagatcttccggcagctggcgggctattctctgggacaggcagacatggtgcgccgagccatgagcaaaaagaaggtcaaggacatcgaacgggagcgggaggcgttccttcacggcgacccggaccggaagattgccgggtgcgccgccagaggtatttccgaggatgtggctcagtccatctacaacgagatttacgatttcgccaactacgccttcaacaaggctcatgccgttgcctatgcggtggtagcgtaccagaccgcctggttcaaatgccaccatacccgggagtacatggcggctctgctcacttccgtgttggactcccaggaaaaggtagcagagtatattgcggagtgccgggagaacggtatccaactgcttcctccggatattaacgagtccggggctaccttcaccgtatccggccaaaatatccgcttcggtctggctgccctgaaaggggtgggacggggatttatggaggctgtcctccgggagcgcgagcggggagggccttttacaacattccctgagttttgtgtgcgtatgtacgactgcgatctaaacaaacgggtgttggacagtctgattcgatcaggctcttttgacagtatgggctatcggagaagccagctgctggctgtttatgagcaggtagtggatgccattgcccgggaccgccgaaaaaatttggagggccagtttgacctattcggtggtggtggagacgctgcggcgatcccagatatggttctgccagatgtggaggagttttcggcccgcgatctgatgcagatggagaaagagaccacaggactctatttgactgggcatcccatggatgagtaccgagagcaggcccgcagacagcaggcggtgccgctggctgcgattctgaccgatttcaagaacgaagaggggcctcaacagtacagcgatgggcaacgggtgaccgtggccgggattatttcgtctgtcagaacaaaaaccaccaagaacaacagccttatggcctatgtgggactggaggacgacacggcctccatggagctgctgtgcttctcacgggtgcttggagacagcggggcctatctgaaagctggggtcgcagtggctgttcaaggcaaaatttctgtccgggacgaaaaggaaccccagcttatggtggaccgggtactcccgctgggcgaaccggggagctgtggaagcaagcagacgttatgggtcaagctggcagatggcggagcgcccttcacatggctgcggcggctgctggatatgttcccggggcaggatccggtgatcatatatctgtcggatcagaagagaaagctgcacacctattgtcaacaccaccaggccttgctgggggagttgggggaagtattgggccaggagaatgttgtgttgaaaggacgatga

SEQ ID NO: 1930 - DNA, 2796 bp, Flavonifractor sp.
atggattacaacaagaccgtccaccttccccaaacggacttccccatgcgggcgagcctgcccaaacgggaaccggatatgctcaaagagatgcatgaccacgacctctaccacaaaatggtggcccgcaacgagggcaagcccaagttcgtcctccacgacggccccccctatgccaacggcaacatccacatcggcaccgccctgaataagattctcaaggacatcatcgtcaagtacaaaaacatgacggggttccaggctccctacgtccccggctgggatacccacggcctgcccattgagtctgcggtgctcaaagataaaaaggtcaagcgggaggagatgaccaccgcccagttccgcacgaaatgcagggagtatgctgaaagctatattgagaagatgaccggccaatttcagcggctgggcgtgctgggtgagtgggaaaatccctacatcaccctgctgcccgaatttgaggccaagcagatcgaggtctttggcaagatggccgagaaggggctcatctacaaggggatgaaaccagtatactggtgtccccacgaccaaaccgctttggccgaggcggagattgagtatgccgacgacccctgcaccactattttcgtaaaattccccgtaaaagacgacaaaggcaagctggggcagtacgccgacctgtcccgcacctactttgtgatctggaccaccactccctggaccattcccggcaactatgccatctgtctcaacgccgaatatgactatgtgctgcttcaggcgccttgcggagacgtgtatatcctggccaaagacctggctaagagcgtgtgtgaagccgcccatatggacttttccgcctgcaccgtgctggccaccctaaaagggtccgaattcgagctgatgaccgccaagcaccccctgtttgaccgggagagcgtgatcctcaacggagagcacgtcaccctggacgccggctccggctgcgtccacaccgctcccggctttggcgccgaggacttcgccatctgccagcagtacgacaaggcgggcctgactcatattggaacccccgtgccggtgaatggcaagggcgtcatgaccgacgaacggtacaacggccagttctataccaagggcaacgacatggtggtggccgacctggaggcggagggcttcctgctggccaaggagaacatcacccactcttaccctcactgctggcggtgcaagcaccccattatctaccgggctaccgagcagtggttctgttccgtggacgcaatcaaggacgcagcggtgaatagctgcgacactatctcctggcatcccgcttggggcaaggaccgtatgatcgccatgatctccgagcgcaacgactggtgcatctcccgccagcgggtgtggggcgtgcccatccccattttctattgtgacgactgcggagcggacatcgttacccctgagaccatcgcccatgtggcccagcttttccgggagcacggctccaacgtctggtttgaccgcgaggccgccggcctgctgcccgagggcttcgtatgccccaagtgcggtaaatcccacttcaccaaagagacggacatcatggatgtgtggttcgactccggctctacctgggccgccgtggccgcagaacgaccctacctgaagtaccccgccgatgtatatttggaagggggcgaccagtatcggggctggttccagtcctctatgctcacctccatcgccgtcaacggtattgctccctacaagcagatcatcacccacggctggaccgtggacggcgagggcaaggctatgcacaagtccctgggcaatgccgtctcccccgacgaggtgatcaaagactatggcgcggacatgctccgcttgtgggtgtcctccgctgactacacccaggatatgcgcatctccccggagatcctcaagcagctctcccaggcctatctgaagattcgcaacaccgcccggtatatgctgggcaacctggcgggctttgatcccgaccaccccgttgccctggcggatctggagtctctggaccggttcgccctggccagcttcaacaacctggtcaagacctgccgggaggcctacgaccgctatgagttccatgcggtctaccgggccgtctacaacttctgcgtcaccgacatgtccaacttctatctggacatcatcaaggaccggctgtactgcggccacgacgcggaccgcgcctccgcccagaccgccttgtacgccattctggacgggatgacccggctgatcgcccccattctggcctttaccagccaggagatctgggcggctatgccccatgcttcctccgctgactcagagtgcgtactttttaacgatattccggactaccggaccgagctggccctgagtgatgaggagttgttccgctggggactgctggtatctctccgggacggggtgaacaaagccctggagaacgcccgcgctgcgggcgtgttcaagaaagcccaggacaccgagctgaccatctccgtggccgaggaaaaggacgccgagttcctgcacagcgccaacctggccgctctgtgcattgtgtccaaggtgaccgtcaccaccgacagcatcgagggtgagcaggtggaggactgtctcattccctgcaccatcgccgtgaaggtgtctgaagcccctaagtgccctcgctgctggaaccatgacgagcacatcggtgcccccggccaccacgccgagctgtgcgaccggtgcgcagccgtgctgggagcgtaa

SEQ ID NO: 1931 - DNA, 2415 bp, Flavonifractor sp.
atgacatacacaccggatgctgctgcagtgaccatgccggcgctggcgctacggggcatcaatgtgtttccccatatgttgctgcattttgacgtggctcgggaggcatccatcaaggctttggacgaggccatgagcacggccagccctatatttctggtgactcagagggatcttaccgtagagcaccctcagcaagaggacctataccctattgggacgattgctacggtgcgacagatcctgcgtttaccagaaaacaatgtccgagtgatggtggagggaacagcccggggccgtctgttgaccctatatcgtgcggaaccttttctgtcggtaggggtagaggaaattcctgctgcgatcaagaaccgggccaattcgtccaagactgaggcgctgattcgtcaaacctatagtctgttggaacgatacaccgagctgtccgaccgggttaccccagagacttatctcaaggtgctggccagcgatgacccggattacattgccgaccatgtggcgcagaatctgccgcttcggtatgaagacaagcagcttattttggaagagttgcggcctgtccgtcgtctggagaagctagttcggatcctcactcgtgaggtggagattttggaggtggagggtgacttagaggccaaggtccacgaacagatggcgggaaaccagcgagattacttcctgcgggagcagttgaaggtgattcagcgggaattgggagaaggagagggcgacgatgagattgccgaataccgggagcgtatcgccagaaccaagttgcctgatgaagtgcgggagaagctggaaaaggaagttcgtcacctagagaagcagccctttggctcgtccgaaggagcggtaatccggggctatctggatacctgcttggagcttccctggatggtcaaaaccaaggagcgggttagtgtcagcgcagtgaaaagggcgctggacgcggaccactttggcctggaaaaagtgaaggagcgtatcctcgagtttgtggccgtcaagcaattggccccagagctgaagggacagattctctgtctggtaggtcctccgggggtaggcaagacctccattgccatgtcagtggcccgagccatgaaccgtaagctggcccgtatttctctggggggtgttcacgacgaggcggagatccggggccaccgtaagacctatgtaggggctatgcccggccgcatcatcaccgctattcggcaggcgggcagcgccaaccccctgttgctgctggacgagatcgacaaggtgggatccgaccaccggggcgaccctgcgtccgctttgctggaagtgctggacgccgagcaaaacagcgcgttccgggaccacttcctggaggtgcccttcgacctgtctgatgtgatgtttattaccaccgccaacactacggaaaccattccccggcccctgctggaccggatggaggtcattgagctgtccagttatacagatgaggaaaagctcgagattgccaagcggcacctgtttccccgccaggtggagcgccatggcttgagcaagcgccaactaaaaatatcggacaacggcctgagggagatcatcaccggatataccaaagaatctggtgtgcgggtgctggaacgacgactggctgccctgtgtcggaaggccgccatggaagtggtgaatacaggtgttaagcagattcgcattacagagaagaatatagagcagtatttgggaatccgccgctatcagccggagaagctgcccgatcaggagcttgtgggcgtggtcaacggtttggcctggacctcagtgggcggcgagatcctggaggtggaggtcaatgtggtcccgggcacgggtaaggtggaactgacgggtaatctgggcgatgtgatgaaggaatccgcccgggcggctttgtcctatattcgcagccgggccgcacagcttgggattgaacctggcttttacaaggatcgggatatccacgtccatttccccgagggggctgttcccaaggatgggccttccgctggcattgccatcaccacagccattgtatctgccctgaccggcaccccggtgaggcgtggcgtggccatgacgggggagattaccctccggggccgtgtgctgcccatcggcgggctgaaggaaaagaccatggcggctctgcgcaacgggatccatacggtgattctcccggcgggcaaccagaaggatttggaggagattgaccagactgtccgggctgctctgcgttttcttcctgtggaccaggcggaccaggtgttggccgaagcattgtccatcgcccctcagccgtctggagatagctcccgcgccatggttgaggagcttgccaacgcagggcagagcgtgacggcgctgcgccagtga

SEQ ID NO: 1932 - DNA, 2148 bp, Flavonifractor sp.
atggccgggcctaacaaaccgagtaaccaaaacaacaatcaaaacgacaacaagaaaaaagctcccattggatttctgggtatcgtgctgtgggcagtggtactagtgctgctgctcaacacctgtatgagctccctgcagaattccagtacggttgaagtgcggtactcggaattccgccagtgggtggaagccgggtatgtggaccaggtggaaatggagtccgatggctactatttcactgtgaaagagggaactccgcccctgacggaatatgcagataaaatcacccaatccctcagcgaacagcagcgcaacctgttcaacagcctgctggggggcaatatgcagcaggctctggaggattccgtcacctttgtcaccgccccggtcacggattacacccttgtccctctcctgaatgacatggatgtggattacggtaccaagcgcgtcaccaacagccagtatatgctgtctgtcatgctgcagaccatcctgcccattctcatcatggtagtcgctatggtgtttatctaccgttatattttcaaaaagatgggttccggcgggatcggcggtgtaggcggcgtaggcaaagctaatgccaaggtgtatgtggagaagaaaaccggcgtcacctttgccgatgtggctggccaggatgaggctaaggaaagcctggaagagatcatcgacttcctccacaatccgggcaagtacaccgagatcggcgccaagctgcccaagggcgctttgctggtggggccgccggggaccggcaagacgttgctggccaaggctgtggccggcgaggccaatgtgcccttcttctccatctcaggttctgactttgtggagatgttcgtgggtgtgggtgccagccgtgtccgcgacctgttcaaggaggccagcaaaatggccccctgcatcatcttcattgatgagatcgacaccatcggcaaatcccgggataaccgtatgggcggtaacgacgaacgagagcagaccctcaaccaattgttggctgagttggacggtttcgacccaggcaagggcgtcatcgtcttgggcgctaccaaccggcctgaggtattggacaaggctctgctccgtcccggccggttcgaccgccgcatcaccatcgaccggcccaacctggctggccgtctggccactctccaggtccatacgcggaacatccgcttggcggaggacgtggacttgaataagatcgcccaggccaccgccggctgcgtgggcgcagatctggccaacctggtcaacgaggccgccctgcgggcggtgcgtatgggccgaaaagcagtcaaccagcaagacctgctcacctcctttgagtttgtcattgcgggcagtgagaagaagggtactgtcctcaccgagcaggaaaagcagatgatcgcctaccatgaagtaggccacgccctggtagcccactatcaaaagaacaacgcgatgcctgtatctaaaatcaccatcgtcccccacacccaaggggcgttgggttacaccctccacctgccggaggaggaaaagttcctcatgacggaggacgacctgctggcggagatccgcaccctgctggcagggcggtccgccgaggaggtggtattcggctccaagtcctctggcgcggccaatgacatcgagcgggctaccgacattgcccgaaagatggtcaccatgttcggaatgagcgacaagtacggcatgatggggctggccacggtgcagaaccagtacctggatggccagatgggcctgacctgcgcccaagataccgctgctggcatcgacaacgaggtgcggtccatcattgaccgctgccatgccgatgccatccgcactctggaagagcaccgggagctgctggacaaaatcgcctcctacctgctggaaaaggagaccatcactggtgcggagatggttgccatcattcaaggccgggatcccgccttggcagaggtctcccttcctggagatattgagcccccggccaagtccatccgcatgaccaacgaacctattcccatgccccccgcagacggcggagtccctcccagtcaagatggcggggcggatggggacagctctcctgatgccccggatcatgtctcttgggattga

SEQ ID NO: 1933 - DNA, 2004 bp, Flavonifractor sp.
atggggcactgccccggccctgcgacggcgcagaacttgattgagaaaggaatggataccatgaaaatgaaacgcacgctcgccctgctgctggccttggcgatggccctgtccctggctgcctgcggcgactccaattccggcgatgatggctcggccgtctaccgcaccctctactccgccgagggagagaccatgaactatctcaccactactacggccaacaatctggagatccctgccaacgtggtggataccctcattgagtacgattgctatggagtggtccagccggcccttgccgagagctgggagcacaacgatgattacaccgaatggaccttccatatccgtcaaggggtcaagtgggtggataaggatggcaacgaggtggccgaagtcaccgcccaggactgggtagatgccgcccactatattctggacgccaagaatgactctggcagcgagtataacttcgaagtagcccaggtgaccaacgccgcggcctactacgagtacaccgcctaccagctggcgctggaaaccgctaccgacggcaccgacgacaacggcaaccctgtcaagctggacgagaacggcgacatgatcgaagaggtgcctgaggtttccgcggacgacatcggggtgaaggccactgacacctatactctggtctacaccttggattccccctgctcctacttcctgtccatgctgtgctgggccgcttacatgcctgtcaacggcgagtttttggctgagtgcggcgacagctttggcaccagcgccgagactttgctcttctgcggccccttcatcctgtccaccttcgagccccaggtacagcgggtcatgaccaaaaacgctgcttactgggacatcgacaatgtgcatattgacaccatccagatgacgtataacgcagagtcctccaccctggctacccagatgtacctggacggctccattgactacgccgatatcagcgcagacctgctcacctccttgctggagacccacagtgatcagatccattactcccggcccgacgtgtcctattcctactggtacctgttcaatttcgatcccaaattcgacgaggagtacgagccggacaactggcgcatcgccgtcaacaacgaaaacttccgacagtccatcatgcacggtctggaccgagtcaacgcccttcaggccaaggatgccaacgacccggaaagcctgctgagcaacaccatcactcctctgggcgccgcgtccgcctctcaggattatgcctactacggcggcttggacaagtatacggacggcgagacctttgacgcggagctggccctggagtataaggagaaggccatggcggaactggaggccgaaggctgcaccttccccgtcattgtctactacccctacaatcccaacgagacgaattccgattccatggcccagctggtagagcagcagctggagggcctgctgggcaccgactatattgacgtggtcatccagcagggcaatgagagcttcctgaccatggtccgtcgggcgggcaactatggcatcaccctgtgcaactggggcgctgactactccgacgcctccgcctatgtcgtggaccccttcgacgaggattccagttacagctttatctatcggagcgacgaccctgaaactcagggctactaccagcagtacctggatctggtggagaccgccctggccaccaccgatgatatcgaggcccggtatgagacttttgcccaggcggaggctgtcctgttggaccacgccttcgcgatccccatcaaaaccaatgaccgggagtattccttctccaagctcaaccccctggagggctcctacgcctccttcggctttgccacttcccgttataagttccagcatgtactggagaaatccatgggcatggaagaatttgagcaagcctatcagacttggctggaggagcgtgacgctgctctggcagctgctgccgaatcttaa

SEQ ID NO: 1934 - DNA, 2124 bp, Flavonifractor sp.
atggatcaatacataggtaaaatgctcgagaaccgatatgagatcctagagtgtatcggtatcggcggcatggcaatggtatataaaagccgggatcaccggctcaaccgcttggttgccattaagatattgaagccagaattggccagtgacgcggagttccgccgccggtttcacgacgagtcccaggcggtagcaatgctgtcccatgtaaacattgtagccatttacgacgtcagccggtctgatgaactggactatattgtcatggaactggtggacggcatgaccctcaagcagtacatgaaaaagcggggtactcctctgagttggcgggaggcactccattttattacccagatcgtccgggccctcggccatgcccacagccggggaatcatccatcgggacatcaagcctcagaatatcatggttctccgggacgggagcgtaaaggttacagattttggcattgcccgggtggccagcgccgcccaggctacgttgacccaggaggcactgggctcggtccactatatctccccggagcaggcgcggggcagtcatatcgacggccgttccgacctgtattccgccggtgtggtactttatgagatgctcactggacggctcccctttgagggagagactccggtgtctgtggccatacagcatatcaactccattcccattccgcccagggatctgaacccggatattccgtcggcattggaggccatcacgctgaaggctatgtcccccaaagcggaaaatcggtatgcttccgccgatgagatgctggctgatttggaggagttccgtaagaatccggatgtgacgccggagcatgcccggcaggatgacgatgcgttgatggaagagcctacccgggtagttccggtatccgagatccgccaggaggaatcccagcagcgtgtccgaaggacacagccggaggcgaaccgggacagagaccgcatcccggagcagcaggcccgacggtctccccgtgtggagcgaccagcggccagagacggctatgacgactacgatgaggaacccagacgccggggcgtccccccatttttgatcgccattttggccattctggtctttgtaggtggactaattttctttgcttataacttcttcctgaaggggatgtttgaaccgcaggatgcccagctcagggtacccgaccttaccccatataactactcggagctaaaagagaacacaagcctgtacgagggctttaccattgaagtggtggaagagcggtccaccggcgactatgcggcgggcacagtgctggaccaggaccccaaggcggataccctgattcaggatggggacagcacggttattaagttggtgatcgccgtaggggaagagcccatacccatgcctaatgtggtgggtcagttgggcgtgaatgccaacagtaatctgatggatttggggctgatcccccagttggaatatgagtacagcgatgatgtagactccgacctggtaatccgcaccattccggaggctggcgaagagctgtatgaaggcgatacggtgattgtcatcatcagtcaggggaaaaaggcggagcaggttacagtacccaacttcctgaatatgcctgtggaggagctggaagaggcagtaaatgcggccggattgacaatgggttcggttcagcctttcccgagcagtgactacgataaggaccgaatttcttaccagagcattgtaggaggaaaggaagtggaccgggggaccaccatcaatttctgggtgagcaccggctccggtgaagaggagccttctccctcgccctcagagtctctcccgcccacgcccagtggagatcccaatgcctccccagatcccggacccagtgataccatggctgttgttacgaataagacaattccgatagatttgagtcagtttgatggcgataaagtggacctgcgggtagaagtaggcggcaaagttgtattcagcggtaatgtggataccagcattgggaacaaggatattctggtttccgggacgggtaggcagttggtggagatctacgacggcaacacactggtcggctcctactacctggatttttcagcgtga

SEQ ID NO: 1935 - DNA, 3204 bp, Flavonifractor sp.
atgccgctggaccgtaacatcaaaaaggtactggttctgggttctggccccatcgtcatcggccaggctgcggagtttgactacgccggtacccaggcctgccgcgccttgaaggaagagggcatcgaggtggtgctggtcaattccaaccccgctaccatcatgacggataaggacattgccgaccatgtttacatcgagccactgaacactgcttccgtcacccaagtcatcgagatggagcgccccgactccattttgcccaccctgggcggccagacggggctgaacctggccatggccttgcatgaggatggcacactggccaaatatggtgtgcgccttctaggcaccagcccggagtccatccgcaaggcggaggaccgacagggcttcaaggactgcatggaggagatcggacagccctgcgtcacctccgacgtggtggagagcgtggaggatgcggtgtcctttgccgattccatcgggtaccccgtcatcgtccgcccggcgtacaccctgggcgggaccggcggcggcattgcctatgacgagccgtcgctgcgggagatcgccgaccgaggcatccacctcagccgggtgggccaggtgctcatcgagcggtgcatctccggctggaaggagatcgagttcgaggtgatgcgggacagcgccggcaacgtcatcaccatctgttccatggagaacatcgaccctgtgggcgtccacaccggggactccatcgtggtggctcccacccagaccttagccaacaaggagttccagatgctgcgctccgccgcactggagatcatctccgcgttggagatcgagggcggctgcaatgtccagttcgccctcaagccagacagcttcgagtacgcggtcatcgaggtcaatccccgggtcagccgctcctctgcgctggcttctaaggccacgggctatcccatcgctaaggtggcagccaaggtggctctgggctatactctggacgagatccccaacgcggtcaccggaaagaccaaggcctgctttgagcctacggtggactactgtgtgctgaagatcccccgcctgccctttgacaagttcaccactgccagccgcaccctgggtacccagatgaaggccaccggcgaggtcatggccatcggcaactccttcgagggggcgctgatgaaggcggtgcgctctctggagcagaacgtgcatgccttgcgcctgcccaagcacatcgagctgagcgacgaggaaatcgaggaaaagcttagcgatgtggacgacgagcgcatcttcgtggtgaccgaggctctgcgccggggtatttcctccgatgtcatcttcaacgccaccaagatcgaccgctggttcctggaccggctccagatgattgtggatatggagaacaccctccgggcgggcacgttggaccccgccaccatgcagctggccaaggagatgggctttgccgacagttatatcggcttcctgtgcgggaaggagcgcaaggagatcaaggccctgcgggaatctatgggcatccggcccgcctttaagatggtggacacctgtgccgctgagttcgacgcggaaactccctattattattccacctacgaccaggagaacgaggccgatacccccgacaccggcaagaaaaaagtactggtgcttggttccggacccatccgcatcggacagggcatcgagttcgactactgctcggtccactccgtctggtcactgaaaaagctgggctgtgagaccatcattatcaacaacaatccggagacagtttccacggattttgatgtggcggataagctgtactttgagcctctcaccgctgaggatgtggagaacatcgtggagcaggagaagccttggggcgcggtggtccagttcggaggacagaccgccatcaagctggccaaggcgctcacagacatgggcgtgcctattctgggcacctcttccgacggtgtggacgccgccgaggaccgggagcggtttgacgagattttgaaccagtgccgcatcccccgggccaagggcaagaccgtgttcaccaccgagcaggccatcgccgcggccaacgagatcggctaccccgtgctggtgcgcccctcctatgtgctgggcggacagggcatggagatcgcctataacgaccgcaatatccaggatttcatgcgcatcatcaatcagaccgtgcaggagcaccccatcctcattgataagtacctcatgggccgggaggtggaggtggacggcgtgttcgacggggaggacatcctcattcccggcgtgatggagcatgtggagcgggccggcgtccactccggcgactccatctctgtctatcccaccatccacgtggaggataagcacaagcagacgatcgagaagtacacttacgacctggccaaagctttgggggtcattgggctgatcaacattcagtttatcatctacaatgacgaggtgtacgtcattgaggtcaacccccgctcctcccgtaccattccctatatctccaaggtcaccggcgtccccattatcgacctggccaccaaggtgatgatgggacagaagctgaaagatttgggttacggcaccggcatttataaggaggccgattactacgctgtgaaaatgcctgtgttctcctttgagaagctcactgacgtggacaccggcctggggcctgagatgaagtccactggcgaggttctgggcattgccgagtccttcccccaggcgctgttgaaggccttcaagggggccaacatgaaggtgcccaagaagggcggacgcatcatcgtcaccgtcaaggacgaggacaagggtgagctgatcggaatcgcccgaggctttgcggatatggggattgagattctggccacggcaggcacctgcaaggctctgcgggatgccggagtggagtgcactcaggtggcccgcatctccgaggcacaccccaacatcggggacatgattgcctcaggtaccatcgacctggtcatcaacacgcccacccggggccgcaagcatgataccgacggcttcaagatccgccgggccacggtggagcactctgtaggctgcgtcaccgccatcgacaccgccagggccatgcttaccgtccgggagcaggggaggagcgccgacctgcgccccatcgacatcaccaaaatttaa

SEQ ID NO: 1936 - DNA, 3000 bp, Flavonifractor sp.
atgctgaagctatctcagatcaaaaaaagctataccgtaggggacaacaccgtggaggccctgcggggagtggacctggagttccgggaaaacgagttcgtctccatccttggtccctcgggctgcggcaagaccaccacgctgaatatcatcggtggactggaccgttacaccagcggcgacctcatcatcaacggccgctccaccaaggagtacagcgacagcgactgggacgcctaccgcaaccactccgtgggctttgtgttccaaagctataacctcatcccccaccagacggtgctggccaatgtggagctagccctgactctggccggcgtgtccaaggccgagcgtcaccgccgggcccgggaggcactggaaaaggtgggactggccgaccagatgtacaaaaagcccaatcagatgtctgggggccagatgcagcgggtggccatcgcccgtgccctgatcaatgacccggatattctcctggccgacgaaccaaccggcgcgttggacagcgagacgtccgtgcaggtgatggagctgctcaaggaggtggcccgggaccggctggtcatcatggtcacccacaacccggagctggccgaaacctattctacccgtattattcgcctgaaagacggacaggtggtagacgactccgacccctaccacgccggggagcgcgcgccggcggtcaccggcaaggcagcccgggcagggaaaaagacctctatgtccttcctcaccgccttatccctatcgttgaacaacctgatgacaaaaaagggacgcacggtgctcaccgcctttgccgggtccatcggcatcatcggcatcgccctgatcctgtccctgtcctccggcatcaacgactatatcggacaggtacaggaggataccctgaccagctatcctatcaccatccaaggcgagagcgtggatatgtccaccatgctcacttctcttatgggggcgcagcatgaaggggagaatcatgctctggatcaggtgtatacttccaccgtgatgtatgacctaatggactccatgctcaacgcagagaccgtgaccaacaacctgcgggacttcaagacctggctggatgagggaggcggcggtatcacggacctggccaccgtccggtatggatataattttcagtttgacatctacaatgaggacgagaacggcaccatcgtgaaaagcgatgtgacgagtctgatgcaggaggctatgtctgccatgtacggcggagactattcctcttacttcgactccatgggcgccatgtatgagagcatggacgtatgggatgaactgcttcccggcgaggacgggcagctgattgcccagcaggagaaggagggatacgacctgctctacggcaagtggccggagagctatgatgaggtcatcctcttcgtggacgagaacaacgaggtatccgacctgatgctgtatgccctggggctgatgagccacgacgagatgaccgagactctcaccgccctgcagaatggagagagcgtggaggagcaggcccgtacctggagctatgaagagctgtgccagaccacctttaagctcatcctcccggcggagtactaccagtatgatgagagcaccgggacctatgccgacctgtccgccacccaggcggggctggagctgctgtacaacagcggcgacgtgggtacggaactcaaggtcgtgggcattgcccggcctaacggggagtccgccgtgggcgggaccatgctggccgggtccatcggctacaccagcgccctgacagactatgccatcgagaccactgcccgggcggacatcgtacaggagcagttggctgatccggacacagatgtgttcaacggcctgcctttcgctaccggggatgagacggagcctaccgaccaggagaagatggacgccatcgccgaatacctccagaccttggacaccgcgggaaaggctgccgcctatacttccgccgcagcccaacccagccaggactatgtggaccaagtggtggagcagcagatggacggcctcacccgggaggatattgaggccatgatcgcccagcagtacgctggagagatgggtgtggacgcggaaaccatcaccgcctatatcgctgacatgagcgacgaggagctgtttgagcaggtggaacaggcagccgccggccaggtgcgggagcagtatgccgccgctgtggaagggcggctggccgccatgagcagcgagcagctggccgctatgctggacctggcgctggagcagggaccagtagaggattccacgtccggtggattgacccaggagcagctggtttacctctatgacaacgatatgcctcccacggtgtctgactccacctacgaggacaatctggaccggctgagctatgtggacctggacagcccggataccatcagcatctatgcctctacctttgcggacaaggacgctgtggccgaccagatcgcggcatacaacgccggggtggcaaacgaagaggatgagatcacttacaccgactatgtggctctgcttatgagttccatcacggatatcatcagcggtatcagctatgtgctgatcgccttcgtgtccatctctctgattgtgtcctccattatgatcggtattatcacatatatttccgttctggaacgcaccaaggagatcggcatcctccgggcggtgggcgcgtccaagcgggatatctcccgggtgttcaatgccgagacgctgatcgtgggcctgggagcggggctgctgggtatcttggtgacggtgttgctcaccattcccatcaacgccatcctgctcagcctgacgggtatcgagggcctgcgggcggccctgcctgtggcgggggcggttatcctggtagccatcagcgcgttgttgaccatcatcgccgggctgatcccctcccgcgtggccgcccggaaagatccagtggaggcgctgcgaagtgaataa

SEQ ID NO: 1937 - DNA, 2055 bp, Flavonifractor sp.
atggtctttcacaagttttttcttgttttggacaaaaaaacattgtttgcaggtatctccctagtttgttatgatgactttagccaaaagaaaggagcatttctcatgaagaatcgtctcaagcgcacaatttcagcggtgctcaccttgtccctgctgatgtctatctgcgccctgccctcactggcggccggcggcgagggagcggactccgctcagggaacctttgagctgctgaaaaacatcgccgtcaccgacagcccctataccccggagggggattattccttctatctctactccccctcggatccccacgactttgacttgatgagcggccagctcaacgcggtcatctttgtctatccagaccaaccttttgcctcccaggaggaggcctatgcccggctagaagagctgggcctgatcgacattgccgagagcgccccggcctacatcatctgccccaaccccctcaatggggagagctatacccaggacgacctgaacgtctattatgaatcccagatctatctggctggcggcaagatcatctccttcaccccgcccgctggcgagtacgagcggcgcacctataacaatttgcagtacatcgttgccgaaggcagcggcgctacctttgtccacaacgtcctgtcccagaacgccagccggattgcctccattctcacctttggcggcgagatggatgagggtctggaccagggccttgccctgcccgcttatctggtgtcccccagccagaccgccgtggattactataaggccgtgaatggcacagacagcgaacccgaggccggccgtttcgtcaacagcagctacacagaaaagcaggtcatcgtcaaagacggcagcagccgctttgatgccgcaacaatcgccaaggcctggggcactctgctgtctcggatcacccgtgcccccatgcagagcgatgtggtggccaacacctttgatatgagcgaatgggtgctcatgtcctggcccaactacagcgagctgggcctgaccctgaaggagcacacctatccgtacgacggcaaggattatgtggtctatgactacatccccgactcctacaccggggacgaagccgtccccttggtggtgctgctccatgggttcagcgaggaccccttgtgccccgcggccacctgcggctgggccgatgtggccgctgaggaaggctttatcctagtggcccccgattatctcaacgacattgagagcaagggcatcgcggtggactgtgtcatgcagatcgtcaaggagacattggagacttacaacatcgatcgttcccgggtctacctcaccggcttctccatgggcggcatgaacacattcttcaccagctacctcaacacggaaaccttcgccgccatcgctccaatggctggcttccccgccattgcggaaaccattgacaccggcgcggaggaatacgatctgcccaccttcttcctcaccggcctggccgatgacaaaaatgtctccttctacgaggacggcaccatcggggttaatgccatgggcgggaatacagctgccgctgccctgcgcttcaatggcattgaggtgggcgagccagactattccctcaacccctggggctatcaggccgatgacagcgactccttcatccggcagggcatccgttacgatgtcagcgatttctacgccaacggctataccaatcccatggtccgtctggtgggcgtggaaaatgtggcccatgcctgctccaacgtatatgcctctctagcctgggactatatctcccgcttcgcccggggcgaggacggttccgtggtggagctggtcagcggctccggcaatcccgctccggacactccctccgacccggagccttcctctacctatgtggtgcaaaagggcgacagcctgtggaaaatcgccaaggagcttctgggcagcggctcccgctggaacgagctgtatgaggccaaccgggacgtcattcggaacccgaacaaaatctatgtgggactagagcttgccatccccggctga

SEQ ID NO: 1938 - DNA, 1833 bp, Flavonifractor sp.
atgccggaggatttgagccggatcacagatcaacaggcggaacaattgtgtgcacagctgcgggaacggctgatcgaagttgtttcccagacgggggggcacttagcgtccaatctgggcgtagtggaactcaccgtagcgatccaccgggtatttcatactgagtgggacaggctggtgtttgatgtgggacaccagtgctattgccataagatattgaccgggcggaacggggctatggagacactgcggtcctttggcgggctgtctggatttcccaagcccaatgagagccgttcggacgcttttgtggctgggcacgcatccaacgctgtatctgtggccctggggatggccagagccaggacgctgctgggggaagattatgatgtgctcgctctgctgggagatggggctctcactggagggttgtcctatgaagggctgaccaatgcgggacagagtggagagcggcttattgtcattctcaatgataacggcatgtctattacccccaatgtgggcagcatcgccaactatttagctcaccagcggctcaagccgcaatatctgcggctgaaaaagctgtaccggggactgacgggccatggcccggtaggccgggcagtctatcactttacccatgtggtcaaaaaagcggttaaggatgcgatccttccgtgcagcatgtttgaggatatgggattttcctatgtgggtccggtggacgggcacgacgtcaaacagctcactcgggtgctgacttacgccaaagatctaggcggtccggtactggtccatgtcaaaacgcaaaaggggaagggctatcccttggcagagcgagagcctgaccgttttcacgggattggtccctttgacccagagacaggagagaacctgcggggagggagtgccagcttttcggctgtgttcggacagtccctctgccagctagcagagcaggatggccgcatttgcgccattacggcggccatgcagtcgggaactggattggatgagtttgcccgtcggtttcctgcacgcttttttgatgttggcatcacagaggggcatgccgtatctatggcaggtggtatggcgaaacagcgcctgctgccagtgtttgccgtctactctacctttttgcagcgttcttacgatatgctgctccatgacgtggcgttgcaaaaactccatgtggtgctggcggtggaccgtgctgggctggtgggcgaggacggggagacccaccaggggatatttgatatcgcatacctcagttccgtacctggcatgagtattctgtgccctgccagcttcgcggaattaaaagccatgctggaacatgctctgttcaaaatgcgcgggcctgtggccgtgcgctatccccgagggggagaggggcggttccggcaaaacctgggcgtagaggggactgccatggcgcgccggggaaatgacatcacgctgattgcctatgggacaatgattaacgtagcgctggatgcggcggaccagctggaacagcaggggatctctgtccgcgtcctgaagcttaacagcattcgacctttagacataggtcccattcagcaagccgcgctggagacccgtcacctgctggtggcagaggagtgtggatctcctggctgcgctggacaccagattgcggctaaacttttagaaactgggatggttcccaatactttgacgctggtcaatctgggggagcagttcgtcccccatggcacggtggaccagttgcggaaactgtgcgggatcgatgcggcgtccattgtgcaaaaggcgtgggaggtgttgggccgtggctaa

SEQ ID NO: 1939 - DNA, 2085 bp, Flavonifractor sp.
atggagctttcggacgtttttgccggcgcggcgctgtccgccggtcccagccagcaggcggcctctgccgccccctctctggggcagaccctggccgacgcctgggatacggttgtctacggcgtgagctggtttttcggcaatatggagccggccggcatctgggctatccctaccttggcggcagccattgcctttttcatctatttctggaaggtgtccgccccccggaagaactctctggagtggatcgccatggcggaggcacagccccggcagatgaccctcaccctcaagcggcacccctttcagaaaaaagacgtgctgcctatgctgttggtgacggtgatttacgccgtcagcgcctttttccagttgggcaacacccacgccccccagagctataccgtctttgacgaggacacctccatcagcttttcctacagtcaggtggtggatgtgagcaagatctctttctttaccgtcatcggcaccggctcctacaccctggagtattctgccgacggggtgaactggtccagcctggaactggaacagccctataactccctgctgaaatgggaggtgaaggacctgaattccccggaagagggagaagagacgcccgtgggccccatctccggccggctgttccgcatctccgcgtctgatatcgaccgcagcgaaggactgtggctgggtgagctggtgctttggaatggggacaccgcgctcgcccctgtctatgtggacgaggggggatccgccctctttgacgaacccatggagtggaccgccaaagccacctatatgaactcctcctattttgacgagatctatcatccccgcaccgccctggaacacctgaacaacgtctatccctacgaggtgtcccacccgcccctgggcaagctcatcatctccctgggcatcctgatgtttggcatgactcccttcggctggcggttcatgggcaccctgttcggcgtactgatgctgccggtgctctatgtgttcctgaaaaacctctttggcaagaccccggtggccctgtgcggcacctgtctgttcgcctttgacttcatgcacctggtacagacccgcatcgccaccattgacacctacggggtgttcttcattctggtgtcctactacttcatgtaccgctggttgaccgtgcctgccggtaccctgcttcgcaagtctgtgccctctctgtttttgtgcgggctgttctggggtatcggctgcgctagcaagtggacggtggtgtacgccggcgcgggactggccctgttgtggctgctgggcctcatcttcaagggccgggagtggcggcagttggccgtccgggagaactccatgggcctgcactcctctctgccccggttcggcacccatgtggccgggaccatcgccctgtcggtggtatttttcattctcattcccgtatgcatctatgtggcggcctaccttccctacgccaccgccgcggcggccagggacggcacgcaggtcaccctgcagagcttgctgtccatcgtgtgggacaaccaggtatttatgctcacctaccatcagggcgtccacaccccccacccctacgagtcctactggtacgagtggatctttgacggtcgtcccatcctgtactaccgggacctggactacgccaacaccgagggcatcaagagcctgttcgcctccttcaacaaccccctggtgtcctggactgggctgctggccttcttcgccatggttatcgaggccatccggaaaaagagcggcaaggctctgttcatcctcatcgccattctgtcccaattcgtcccctggctgtttatcggccgcatcctattcgcctaccactacttccccacggtcctgttcctggtattcgccatcgcttacctcatggatcgtatgctggagcgccgccgggcggggtatgctctggcgatctatggcttcacggggtacaccgtggcgctgtacgccgtattttatcccgcactcatcggcctgtacaccccgctgtggtataactctatccttctgcgttggttccccagctggccgctgtga

SEQ ID NO: 1940 - DNA, 2634 bp, Flavonifractor sp.
gtgagccaatggttcaccaaaacccctgaccaggtcatgtccgagttaggtgccgaccaacgccggggcttgaccagccgccaggcggaagaacggctggaaaagcacggccccaaccgattagagggcgccaaaaaggagagcttagccaagcgcttcctcaaccagatgaaggaccccatgatcatcgtgctgctggccgccgccgtgctgtccctcatctcctccggcggtgaggagtggatcgaggcggtcatcattctggtcatcgtcattgtcaacgccattatctccatctcccaggaaaacagcgcggaaaaggccctggaggctttgcagaaaatgtcggctcccctggccaaagtgctgcgggacggccagctggtccgactggagaccgacaagctggtccccggcgacatcatcgtgctggaagccggcgacctggtccctgccgacgcccgcatcctggagtgtgccaacctaaaagcggatgagtcggctatgaccggcgagtccgtccccgtcagcaagcaagctgtgaactccctgcccgaagagaccgccctgggtgaccggaagaacatggtcatctcctccaccgtcatcaccaacggccgggccacctgtgtggtcactgccaccggaatggacacggaagtgggccgcatcgctcagatgctcaccagtgaggacgatacctccaccccgcttcagcgaaagatggccgagatttccaagaccctgtcctttgtatgcctggcggtgtgcgccgtcatgttcggggtgggcctgctgtaccagaagggcttgctggagatgttcatgtccgccgtgtccctggcggtggccgccatcccagagggcctgcccgccattgtcaccatcgtgctggctctgggcgtacagcggatggtgaagtacaatgccattgtaaaaaagctgcccgcggtggagaccctgggctgcgccggagtgatctgctcggataagaccggcaccctgaccatgaataagatgaccgtggtggaggtgtggtcccaaggggatcagcatcggaaggaagcactcaccatcggcgcactgtgcaatgataccaccctgacctatcaggaagacggctccattaagaccgccggtgaccccaccgagactgcctttgtggacatcgcctgcaaagagggactggataaaaacaagctggaggcggagatgccccgcaccgccgagctgcccttcgattctgaccgcaagctcatgagcacggtccatcccgtgaacggccggctgcgggtgatggtcaagggcgctcccgacgtgctgctgtcccgctgcacccacattctggacggctctgtcaaggcgcttacctccgcccacacgaaacaagtggaggcggccaacgccgctatggcggaaaaagccctgcgtgtgctgggctgcgcctataaggacattgacgcgctgccccaaggtgagctgaccacagaaaacctggaaaccgacttgaccttcgtgggcttggtgggcatgatcgatccgccccggatggaggtcaagcaggcggtggccgagtgctacggcgcgggcatccgcccggtgatgatcactggcgaccacaaactcaccgccgtggccatcgccaaggagctggacatctaccgggacggcgacctggccattaccggcgaggatctggattttatgagtcaggacatgctggagcaggacgtggacaaattctctgtctacgcccgggtgtctccggagcataagatgcgcattgtcaaggcctggcagaagaagggcatggtggtggccatgaccggcgatggcgtcaacgacgcccccgccctgaaggtggctgacatcggctgcgccatgggcatcaccggcaccgacgtggctaagggcgcggcggacatgatcctcaccgacgacaacttcgccaccatcgtccatgcggtggagcagggccgaggcatctactccaatatcaaaaaagccattcactaccttctgtcctgcaacattggcgagatcgttaccctgtttctggccaccctgttcaacttccaccaggaccccctggtccctgtccagctactgtggctgaacctggtcaccgactccctgcccgccctggccctgggcatggagccggtggagcactccgtcatgcaggagaagccccgctccgccaaggagtccctgttcaataagggcttctccatccgcctggcctggcagggcgccatggtgggcctgctcaccctggccgcctatttcctgggcgagtatgtcctcagtgacccttcggtggccgatgccaccgccaacaccatggccttcgctaccctgaccttctgccagctgttccacgcctttgacgtgagaagcgaggaccagtccatcttcaagctgggcatcctgtctaacccggccatgaacaaggccttcttagtcggcatggtgctccagctggcggtgctgctggtgcctcctctgatgggtgtgttcgaggtgtgcgccctcaccgccccggagtgggctgtggtactgggcctgtctattctccccgtcattatctgcgagatcgaaaaagcggtccgccgtgccctgcgcaagaactaa

SEQ ID NO: 1941 - DNA, 2646 bp, Flavonifractor sp.
ttggcccgtgggcgcaagaaaaaggaggaaatgcatatgaagttgaagaagcttacagccatggtgctgtccgcctcgttggtggtcagcttggctgcggcaagcgcgtttgcggcgcctcccgagggcggagcccccggtggtcctggtggcggccccggcggtccggcagctgaatttaagctggagggccaactgtccgtctggctcaaggatggcgttgtggttgcccccggtacggagggcgcaactgaaaagaaggttgaccgcattgttaccagcaatgaggacaacatcagttccttcggtggcggcggcacggatgcgtctactgtggccggtgacgactacgcttttgtcaccgctctgtatgtgaaggacggccaagtggtggccaatcagtctgtcaccgaggccatttccaagggtacttatgatggacagtccgccaccggcctggtcatcaagagcgagtacgagggctttaaccccattattgtggtggactctgagtacaacatcacgggcgccaacatcaccatcgacagcaatggcgatggctccaagacctgcgacttctccggcctgggcgctgccatcgccgcttatggcgacgaaactgtgctggtcattgatgattctgaggtcaacgtgtccggcgtggccaaccttggcctgtttgccgacgacggcgctgacgtcatcatcaagaactccaagatgcactctgacggcggcaccctgtatgccgactacaagaacagccccgaccagtccaccatggtggctcctccctgggtgctgggtatcatgggaacctcccgcggcaccaacctgatgggcaacaactcttccaccacggtcatcgactctgaggtgagcgccgctcagtgggccgtcctgtccaccgactccggtaccaatatgaagctcaacgtggtgaataccaccatgctgctcaccggcgccgactatgtcatgcagaatgacgacaccttcggcgacaaggctggtaaggactccaacccctacaccactcgctccggctatggcacttacgccatcggcaacgccgacgagtatttctatggtgtagacatgacggtgggcacctacgccactatcttcaccggcggcttcggcacctacactgcgatgaagaagggcgaggagatctccctgtacgacgccaacggaaaggtgttggagacctatacccccactgaggacaaggtgaccaccatcaactccgacacctttggtttcatgatccatcagggcaccaatgagatcaccattgagaagggcactgtggtcaactccggctacaccaccttcctgctgaagaccggcgccagcggctccaatgtgacggctgacatcacctccggctccaagctgaaccccggcaacggcatcctgatccaggccatggacaacgatgactccaccaccgggatgatctccttctctgagggcttcaacaccacccacactgaggagcctggctggcacaccgccggcaatggcgccgctgctgacaacaccagcacctttaactttgacgatgtggagctggtgggcgacatcttcaacggcaccggctatcagagcgctcctggcatgatggatcccacccccgctcccatggcccccaccaagctggccatcaacctgagtggtgacacctccctgactggtatgatctccgccacggacatcatccatgtgaccaaggaaggctctgacgctgttaaggcggccgccgctggcgagaaggcctctgaggattggctccagtatcaactaaccagcttccccatcggcgagtattataacatcggccaggtggccaaccgcgtattctacaacggacataacgacattgacgtcaccctgaccgagaacgccacttggaaggtcactggcgacggtattgtccataatctgactgctgcggctgacgcgatcactgccgataaggccgtcaccatcactgtgaagggcgttctgaccttggacggcgaggttgtcactggcggcaccaaggtagtcggcaacgtcacttatgtggtggagaccaacctgatggagaactacaccgatcttgctgctgacgcatggtacgccacaggcaaggacggcgagactctgaagtatgtgctggccgccggcctgatggaaggctccagcgccaccaccttctcccctgacaccgctctgacccgtgagcagctggccgtgattctgtaccgcgccgctggcgagcctgaggtgactgacgagctgaccgctcccgacgccgcctctgtgtcctcctgggctgctgacgccatgaagtgggccgtggctgagggtatcattactggcgactccgccggcaatatcctgcccgccggcactgtggaccgtcagaccatggccgtcatgctcttccgctgggctgagggcactgtggccgaggacgccgacctgtccgcctatacggatgccgcctccgtggcctcctgggctgtggacggcatgacctgggctgtggctgagggcatcgttcagggcacgaacaacgagttgctccccggcaacacagtttcccgcgtccaggccgccattatgctgggccgctatatgcagaaccagggctga

SEQ ID NO: 1942 - DNA, 2331 bp, Flavonifractor sp.
gtgctggttagcctgattaagagccaggcgtccaaggtgagaaccgagacgttagagcgggtacgggagagcaaagagaaagaggtctactatttctccatggagtttttgatcggacggctactgaataactacctgcttaacttgggtattcaggatgtagtccgttccggcttggcggagcttggagaggatttggaccgcatctgtgccctggaacgggacccgggacttggcaacggcggcctgggccgcctggccgcctgctttatggattccatggcatttctgggcgtgcctggaggcggcatggggatccgctaccgatttggcctgttccagcaaaagattgtgaacggctatcagactgaggtgccagacacctggctggacgctggttatccctgggagacggccaagcgggacgagtccatcgtggtgaagttcggcggctatgtggaccgggagtatcgggacggcaaggtggcgttccagtataagggatatgaccaggtgttggctgtcccctatgacgtcccagttgtggggtatggcggcaagacggtcaatcctctgcggctgtggtacgcgcagcctttggaagagcgttttgacctggcggcgttcaaccggggagattacgctgcggcggtgaagcaccgcaatgaaatcgaggcgattacctgcattctctatccggatgacagtacgctggcgggcaaaaagctgcggttgcagcaggaatacctgctggtggccgccggtgtgggagacttggttcggcggtacaagcggctgtacggggaccgggagtggtctttgatgccccagcggatggccatccacatcaatgacacccatcctaccctgtgtgtgcctgagctgatgcgcctgctcatggatgaggaggcgctggagtgggatgaggcatgggacatcaccacccacaccattgcctataccaaccacacagtgctcccggaggctctggagaaatggcccattgacatgatgcagacaatcctgccccgggtgtatatgattatcgaggagatcgaccgccgcttcaaggagagctttgacaagagccagccggattggcagcggcgccatcaagccactgccattttgtgggatggacaggtaaaaatggccaacctgtccattatcggcagctattcggtcaacggcgtagcggccttgcataccgagatcttaaagaaggacaccctgaaggatttttacgcactgtatcccgagaagttcaataacaaaaccaacggtgttagccaccggcgtttcctgatggaagcgaatcccggcctgacggacctgatcaccagcgcgatcggtccggaatggacgtatcaccctgcggccttggagaggttgctgcccttcaaggaagatagcgccttcctggagaggctggctgccgtcaagcgggagaacaaagtacgtctggccgagcacatccggatcaacaacggtatcgacgtggacccggatagtgtattcgatgtacaggtcaagcgcatccacgcctataagcggcagctgctgtacgcatttaagattatggatctgtataatcagctcagggacgaccccaatatggatattcacccccatacctttatttttgcgggtaaggctgcgggaagctatgtgtttgctaaggaggttatcaaactcattaactctatcgccgacgtggtgaacaatgacccggcggtgaacaataagatgaaagtggtgttcatggagaacttccgcgtgtcctccgctcagatcatttatcccgctgcggagatcagcgaacagatttccaccgcaggcaaggaggccagtggcaccggcaacatgaagtttatgttcaacggagccatcaccctggggactatggacggtgccaacgtggagatccacgacttggtgggagaggaaaatatccgcatcttcggtatgcgggccgaggaggtcatggagcgctatgcccggggagattaccaccccagcgacgtagcgaacgccgacccccgtctcaagcgcatcaccgaccagttggtcaacggctttttccagaagtcgggctgtgatttctggggcgtacgggaagcgctgctcacctatggcgacgagtatttcgtgctgaaagactttgacgactacgtccgtacctggcgggagatggaccggctctactgtgaccggaatgcctggaaccgcatctcgctgcacaatatcgccaaggccggctatttctccagcgaccggaccatcgccgagtacgccaacgacatttggaaggtccgtttcgaccgacgctga

SEQ ID NO: 1943 - DNA, 2247 bp, Flavonifractor sp.
ttggcaaagaaaaaatcccccgagcagaatgggccgaaaaaggtggacaaccccaatgtgctgggcctgcaggcccaggtgctggagcagcccattacccagacgctggaagtcaactatatgccttacgccatgtccgtcatcgtctcccgggccattccggagatcgacggcttcaagcccagccaccgcaagctgctgtacaccatgtaccaaatgcatctgctggggggcagccgcaccaaaagcgccaacgtagtaggggctaccatgaagctcaatccccacggagacgcagctatctacgataccttggtgcgcctgagccgaggctacggcgctctgctccatcccctggtggactccaaagggaatttcggcaaggtctattcccgtgacatggcctgggccgcctcccggtacaccgaggtacggctggatcccatttgccaggagctgttccgggatatcgatcaggacgcagtggatttcgtgcccaactacgacggcaaactcaccgagcctaccctgttgcccaccacctttcccaacgtgctggtatcctccaacatgggtattgccgtgggcatggccagcaatatctgcggctttaacttaggcgaggtgtgcgacgccaccaccgcctacctccgggaccccaatgtggatctgttgagcatcctgaaggctcccgacttctccaccggcgggcagctgctctatgacggtgcggccttggcagacatttaccgtaccggccggggcgggctgaagctgcgggccaagtggcgctatataaaggacgaaaaccttattgagatctatgagatcccttactctaccactgtggaggccatcattgataaggtagccgaactggtcaaagcgggcaaggccaaggaaatcgccgatatgcgggatgaaaccgatctgaacggcctcaagctcacgatcgatctcaagcgcggcgctgatccggacaagctcatggcccggctgttcagggccactcccctccaggacaccttttcctgtaatttcaacattctcattgccggcatgccccgggtgatgggagtcggagagattctggaggaatggaccggctggcggatggacggagtgcgccgacgcacctggtttgcctgtaaaaagaaggaagagaagctccatcttctgaagggtctcaagcgcatcttgctggacattgacaaggccatcgccattatccgggagacggaggaggacgccgaggtggtgcccaatctgatgattggctttggcattgaccaagtccaggcggagtatgtagcggacatcaagctgcgcaacatcaacaaggagtatatcctaaagcgcattgatgaagtggacagcctagaggcggagatttcagacctgaaggacatcgtccactctccggagcgcatcaaggatattatcatctctgagctggaggctgtgaagaagaagtacagcgtaccccggcgcaccgagatcgtttacgagcaccagttggaggcggagcctgacccagtggaagaggctccggactatccggtgcatgtgtttctctcccaggaaggatatctgaaaaagattactccccagtccctgcgcatgagttcagagcaaaagtacaaggaaggggacggccccttccttcagtggacggggaataaccgggatgagctgctggttttcaccgaccatcagcagtgctacaagacccgcctatctgattttgacgacagcaaggccagcgtactgggggactacctgcccaccaagctgggcatggacgcggacgagaaatttgtctgggcctgtcctccgggggactattccgcccatctgctgtttttctttgaaaacggtaaggccgcccgggtggagctgtccgcctaccagactcagacccgccgtaaaaagctcaccggcgcctattccgacaagtctcccctggtgtccgccctggtgctggcggaggatcaggagatggccgtgtgctccaccgaggggcgttgcgtggtattccacaccgcatccctaaaccccaagtccacccggtccactcagggagtcaacatcatgaccctcaagccaaagtacaaggtggagtgggcccgccccttggcggatacttccattgtcaatgccgcccggtaccgggcccgttccctgcccattgccggcgctctgctcaaggacgaggaccggggcgagacccagatgaccttgctgtaa

SEQ ID NO: 1944 - DNA, 1794 bp, Flavonifractor sp.
atgaaaaggaggaaaaccaccatgaaacgaaccctgccccgtttgctcgcaacgctcctgtgcctggcgcttctgttcgccatggctgcctgtggagcaccggataacacgcagagcacacccgtatcggacagcggaagtgccagcaccgagccggtacagactgccgacaccagcacgcccacctacggcggcaccatgaccatgtattaccacgagttctacaactactatgaccccgccatgcccaccagctacagctatgccttttggctagagggcctgtgggccatggactgggacagcgattatgcctacaacaacgactactggacctataagaacgtggacgggcagattgctgatacctgggagattgccgaggactactcatccctgaccgtccacctccgggaggacgtctacttccagagcaaggaagacgcccagtacgatatcttcggcggccggcagctgatggcctctgacgtgaagtacacctacgaccgtatcctgggcctgggatccggctgggatgagccggtggagtgcgagatgaactggccctccgagctgtacatggtggagtccgtagagacggatggagacttcaccgtgattttccacttcaacaccactaccgaggtagccctgaatacctttatgaccacggtggtcaacatcaccggccccgagtgggatgaactgactgcggatcagcaaggcgattggcactatgccgtgggcaccggcccgtttattctcaccaacgtctccgtgggcagctccatgtccttcacccgtaatgacagctattatgactacgacgagcgtaaccccgaaaataagctgccctatttggacggcgtagaacttgtccacatcgacgactctgccaacctgctttcccagttcaccgccggcaccatcgattggatcggctccacctctgcggtgttcaactcctctgagctggcgcagctacgcgccacggtaccagaggattcctacaccgagtatacctacaacaccaatcctcctgctgagatctcgttgaagtgtaatcaagagcccttcaacgatgttcgggtgcgcaaggctctgcaaatggccatcaactgcgatgagatctaccatagctattatggcctggagggcgaagtgatcattcccggcatctgggccacggacctgaccaattactccgcagtggctgactggagtgacgagctcaaggccgagtattcctatgacccggagggagccaaggccctgctggccgaggcggggtatcctgacggctttaccttcacggtggccctggcgcccaatgcggacacggacctgtatgtcctggtgggcacctatctggcagacatcggcgtgaccatggagatcgagcagtgcgccgagatcatggagaccatcagtatttccagcaatcctgacgatacccgtcaagtcagcggcatgcacggtggaaagggcgcgattgccattattaagatgaccactacctccgccggcgccaactatacttacaaccacggcaaccaagcgtatgaggacgcggtgaccggcttcgagcaggcccagaccttggatgagcagtcccagtatgccaaggagatggacctgatctttgcccaggagcactggggcatcgcgctgggcggctatacccagctcaacgaattcatgtccaataagatccatggatacgatgggcagaagcttaccgtcaaccagtaccgccgtaccgttgtcgcccggctgtggatggacgcggagtga

SEQ ID NO: 1945 - DNA, 2370 bp, Flavonifractor sp.
atgtcaattagactggctcttgccggcaaccccaactccggcaagaccaccatgttcaatgctctgaccggctccaaccagcgggtgggtaactggccgggcgtgacggtggaaaagaaagagggacggcttaaagcggataaggagattgccctgaccgacctgccgggcatctattctctgtccccctataccttggaggaagtagtggcccgggagtacttagtgagcgaacggcctgacggcatcatcaacatcgtggacgccaccaatattgagcgcaacctgtacctcaccacccaacttatggaaatgggcattccagtggtggtggccttgaatatgatggacctggtgcgaaaaaacggcgatcagatcgatgccaataagctgtccaaggctctgggctgcccggtggtggaggtgtccgccctgaagggtgaggggctggataagctgctttccacggcgaaggacgcagcagccaaacgatccgcccccacccggctgacttttgcaggccaggtagagtcggccttagcggatatccagtcggtacttgcctctgcggtccccgccggaatggaacgctggtatgcggtcaaggtgtttgagcgggacgaccaggtgatgggcaagctgaccctatccgccgatgccaagagtaaggtggaacgggccattgagaactgtgaaacggctctggacgatgacgcggagtccatcatcaccaacgagcggtatgaacagatcagcaaggtcattgcatcctgcgtcaagaaaggccgcgtgggactgactgtgtccgataagattgaccgcatcgtcaccaaccggattgccgccctgcccatctttgtggtggtcatggctctggtgtactccattgccatgggcggctggaccatttccatcggcacccacctcaccgattgggccaatgacggcctgttcggcgacggctggttcgtccccttcaccgtggacggcgaggcttgggacgaggattccggcgcctttgaggaggcatctgccatcattgaggcctatgaggccggtggctctgaggcatacctgtacgatgatgagaccggcgagacctctgtgctggaagtgaatgaggagacttatcagcaggccctgactgtgcccgaacccgaccccaacgagtacggcgtgtgggtgcccggcctcccggtgctcatcgagaatggcctgaatgccatcggctgtaatgaaatcgtgcaatccttgatcctggacggcattgtgggcggcgtgggtgccgtgctgggctttgtgccccagatgctggtgctgttcctgctgctggctatcctggaggacatcggctacatgtcccggattgcgtttatcatggaccggatcttccgccgtttcggtctgtccggcaagtcctttatccccatgctggtggccaccggatgcggtgtgcccggcatcatggcctctcggaccatcgagcaggaccgggaccggaagatgaccatcatgaccaccggcttcatcccctgcggcgcgaaaatgcccatcattgccctgtttgccggggcgctgttcggcaactccgcctgggtggccacctccgcctacttcatcggcgtggcggcggtcattatctccggcatcattctgaagaagttcaaggccttcgccggtgagcccgcgccctttgtcatggaactgcccgcctaccatgccccctccgcggggaacgtgctgcgctccatgtgggagcggggctggtccttcatcaagcgagccggcacggtcatcctgctgtccaccattgtcctgtggttcctccagggattcggctttgagaacggggccttcggcatggtggaggacaacaataattccatcctggccaacatcggcaacgccatcgcctggatcttcgcgcctctgggcttcggcaactggcaggccaccgtggctacgatcaccggcctcatcgccaaggaggaagtggtgtccaccatgcaggtgtgctatcccggaaacctgaccgccaacatcggcgcggccttcaccggcatcggggcttacgccttcatgatcttcaacctgctgtgcgctccctgctttgccgccatgggcgccatcaagcgggagatgaacaacgccaaatggactttggccgccatcggctatatgtgcggctttgcctatgtgatgagcctgatcgtctaccagatcggcggactcatcactggcgatgtgtcctttaacgtgtttaccgtagtggccattgccttggttgcctgcctggtgtacctgctggtgcgccgtggatacaagggtgaggccgacaacctgcgggccgtggacgtggtcaaggtctga

SEQ ID NO: 1946 - DNA, 2511 bp, Flavonifractor sp.
atgcttcaaagacagaaaaagcccccatccaaggcggccgggcacacacaggcgcgccaggagatgccggaacaggacggggaagcgttacagcaggcccatgcccggaagatcgaacgcatatttcccgatcccaagacggggctgacaagccaacaggcggcggagctgctgcagcacggctacggcaacgagaccgacgatcccaacgtcaagaccacccgccaaatcatccgggaaaacaccttgacctttttcaatctggtttttgtggtgctggcggcgctgctggccatcgtaggcagcttcgcggacatgactttcctgctcatcgccggagccaattccctcatcggcatcatccagcagattcgcagccgggacaccctggccaagctcagcctgctggcggaggccaaggtgaaggtggtgcgggacgggcggctgggcacagtgcccgtccacaagctggtgcgtgaggacatcgtggagctggccgcgggggaccagatccccgccgacgggccggtggtgtccggctcggtgcaggtcaacgaggccctgctcaccggcgaggcggatgccattaccaagcagaccggggaccagctgctctccggcagctttgtagtgtccgggcggtgccgggtccggatggacaaggtgggcgcggagagctatgccgcccggctggcggcaaaggccaaagcggaccagggagtaggcaagtcccagatgatgcagtcgctggacaagctcatccgggtcatcggatacgcccttatccccatcggcattgccctattttgcaacgagatctttgttctagaaaccaccttttttgatgctgtgcccgcagtggtggcctccctcatcggcatgatccccgaggggctgtacctgcttaccagcgtggccctggccgtatcagtggtgcggctggcccagaaaaagaccctggtccatgacatgaactctatcgagacgctggcccgggtggatgtcttgtgtgtggacaagaccggcaccatcaccctgcccgaaatgtcggtgcgggaggtggtctatctggacgaggaggactaccccaaacagcgggtagaggatgtcctcaacgcctgctacaccgccctggacgcggacaacgacaccgcccgggcaatggctgcccggttcaacagacagacccactggccggtggagcggaccatccccttcacctcggccaccaaatggtcggctgtggtattcaaggggcagggggcttatgtcatcggcgcgccggaatttatccttggggcggagtacaagctgctggaacccatggccgccccctaccaggcccaaggctgccgggtgctgctggcggccaagtgcgagacgcctcccgttcagggccagcccctgtctggagtcatcgacccctttgccctggtggtcatcaataaccccatccgtcccgaggcgccggataccttccgctattttgcccagcagggagtggcggtgaaggtcatctccggggacaacccggccaccgtctcccaggtggccctccaggcgggcattgagggggcggagcgattcgtggatgccggggagctgaaggagccggcagactatgcccgggcggtgcgggactacaccgtgtttggccgggtgaccccggaccagaagcgcaagctggtcaaggccctgcaaaaagcggggcacaccgtggctatgaccggcgacggcgtcaacgatgtactggccttgaaggacgcagactgcggcatcgccatggcctccggagcggaggcggcctgccaggtggcccagttggtgctgctggactccaactttgcctccatgcccctggtagtggcggaagggcgcagggtcatcaacaatattcagcggtcagcggccctgtacctggtgaagaacattatgtcgtttgtcttgtcgctgatcaatctgctggcgggcttcccatcgccctttaccccgatgcagctgaccttaatcagcacggtgaccattggaatcccctcctttgttctggcattagagcccaaccatgagatcgtccggggcaagtttatgcagaatgtgctgcgcaaagccctgccaggcggtctgaccaatatcgtgctcatcgtgggcttgcagctgtttacccaggcttttaccttcgagcgggccactctgtccactctctgcaccgtgctcgtgggctttgttgggctgttggtgatctattacgtggcccggcccatggactggaagcggtggctcctgctggggaccatgacggcggtttttgtgacagcggtggtgtggttcggcggtttcttcgggttgaccccgctggacttccagtctgcgctggtcatcgcagtgttcctcatgctggcgccctcggtgatctacgtctttgaaaagctctttgagctgggttccgctgccctaggcctgtggagcgggcgccggacgagccgggagcggaagcagctgctccgccgctga

SEQ ID NO: 1947 - DNA, 2478 bp, Flavonifractor sp.
atggccgtggcaatgccacaggcgttcgcgtccgatgccctgggcagcgacctgaaggggcgcaccgtggagctggcacccggtgtgtccgtgacggacaacagcctgtggagcgccacctattctgatctgcgcacggaatactacgttacatatgagccgggggccgccgcttcaccgctgatttggtacggaagcaccatctccagcaagagccagttggcctccgctgcggcccagctggaggagcagggctaccgggtgctggcgggcatcaacggcggctttttcaacaccgacggcactgctgttggtctagtgatcaccgacggtgtgatccgatctctggaccagtggaactatcatatggtgggcatccgcgccgacggaaccgccttcattgacagcaacaccatcgccaagaccataagctgggccgctttggatggcagcgcggtcaatctgaacctcactgccatcaatgaaagccggaagaacggcggactgtatctgtttacagaggacttcggcaccactacccagaataccgtggccggggtggacgtggtgctggagccggtggcggcggaccagcagctgacgatgaatagtaccacgacttaccgggtggtgcgggtgaccgactccacccaggagggagtgagccaggacaactttattcccacgggctgcctggtgctgtccgccaacaagaactgcgatgcctctctgttggaccctctacgggcgttgacccccggcacccaggtgaccctgaccatctccggcggcgacagcgcctggagccaggcagtgtatggtctgactgggctgtacgccttggtagagaacggtcaggtagtttccggcttagaggcgggccgagccccccggactgccctgggcatcaaagcggacggcagtatggtgttctacaccattgacggtcggcagagcggctactccgtgggtgccacctactctcaggtggcccagcggcttattgagctaggctgtgtccaggcggtggccctggacggcggcggctccaccactctgggggccactttaccgggcagcgatcacttcactgtgctcagttctccctcggacggtaatcagcgggcggtgagcaattgcctgtttctggtaaccactgcccagccaaccggcgtggcagccaagtattatgtggataccgcctctgatgtggtgttggccggggccagcactgcggtgaccgcggcagcggcggatgccagcggctattccgtagccggctccggggcgctcagttggacctccgacggcggcatggtggactatgaccagacgggcggcgccgtgtttaccgccgggacgctggcgggggatttcacggtgaacgtctctgatggcctggcctccggctcggccccggttaaagtggtggaccagctatccaggctggacattactcggaaggacacggggacttctgtgtcctctctgaccctatctccgggggacgtggtggatctggacgccgccggcgtctggtataacctccccgtggccatggaggatgaaaatgtgacctggagtgcggaccccactctggggaccatcgggtctgacggtttgtttacggccggagaggagaacgcagaaggcgttatcactgcctctgccggaggccggaccgtagagatccgggtgaaagtggaccggggcgatcccttcaccgatatcgcagatcactggagccagccctttgtcacgcagctgtaccagatggggctgaccaccggcatccagcagccggatggcacctatctctaccagccggatggaaagctttctcgaggcgagttgctggtgtttatctcccggatgctgggagtggataccgctcaatatgaatcggtggttctacccttcgccgatgcggaccagattgcagactgggcgctgccccatgtgaaagccatgtacaccctccaggtgtttaacggcgtatctgcggacggccagctctacgctagtgtggacgagatggtggaccgccagtcggctatgaccatgctgggacgcattttggcccagcaggtgagctatgacctgtctgtctttgccgatggaggacaggtgtcagattgggcctctacctatgttcagactctggtggctcagggggtcatcaccggcaacggcggctatctgatgccccagagcgagatgacccggggcgaaatggccaaggtcatcacgctggtcagtcagttggctcatgcggagttgacgcccagaggaggagagaccgtagtcccggaagaacctgtccagccgggggagtcggaacagccccaagcttcttcgcccacagatgagccagaggaaacgacggctcccaacggggaagaagcgtctgaagcgacagagggaaccggcgagacggagaggccggatgcggaacaaccagcggaaattccggaaggc

SEQ ID NO: 1948 - DNA, 1857 bp, Flavonifractor sp.
atggctagggcttttaacggaaagcgcccggacaacctgggccacaccctgcgcaccctgttctcctacctaggccgccacaagggcatgatcgccctggtgggagtgctggcggcggtgagtgccgtggccaacctgctgggcacttatatgatcaagcccattgtcaacgacttcatcggtccgggcgatctgtccggcctggtcctaggggtggcagtgacagcagctatctacggtgccggtgccctgtccaccctgggctacacccagatcatggtacgggccgcccaaaaggtgctctacgacatccgccgggacctgtacggccatttgcagaagttgcctctgcgcttttttgaccgccagcgtaaaggcgatctgatgagcctgttcaccaatgatgtggacacggtggccgatgcgctgaacaacagctttgctatgatcattcagagcttcatccaagtggtgggcactctgctgctgctgttcctgctcaactggcggctgtccctggtggtcgtggtaggctatggagccatgtttctctacattcagtacagcagccgccgcagcaaacactactttcgccgccagcaggccagcttgggcgagctggacggctacattgaggagatggtggctggacagaaggtagtcaaggtattcaaccacgagcaggccaacctggacggctttgtggagcgcaacgagcggcttcgtaaggacggcaccagtgcccagagctacgctgctaccatgatccccgcagtagtgaccatctcctacatcaattatgccatcatcgctgtgttgggcgggcttatggtcatttggggctggtccgacgtcggcagcttggccagctatctggtctttgtccggcagtctgccatgcccatcaaccagttcactcagcagggcaacttcctactggccgcacttgcaggggcagagcgcatcttttccactatgaaagaggagccggaaacagacaacggcacagttgaactggtgaacgtctgccaagccgagggcggcacccttgcgcccacacagggaaaaaccggacagtgggcctggcggaacacggccaatccctccgcacccctggttcctctccggggggatgtacgctttgaccacgtcaccttcggctatgagccccgacagaccatcctccaggacatcagcctgtatgccaagccggggcagaagattgcctttgtgggttccactggtgcgggcaaaactaccatcactaacctgatcaaccgattttatgacgttcagggcggcagtatcacctatgatggtattgatgtgcgcagcatccggaaggatgacctacgacactccctgggcattgtccttcaggatactcacctttttaccggaaccgtagcagacaacattcgctttggcaagctggatgccagtcaagaggaaatcgagcgtgccgcagtcattgccaacgcagactccttcattcgtcgcctgccccaaggttatgataccatggtcaccggagacggagccaatctcagccagggtcagcggcagctgctggccatcgcccgggcggcggtggccgatcctccggtgctcattttggacgaggccacctcctccatcgacacccgtaccgagtctcttatcgaaaagggcatggaccagctcatggaggggcggaccgtgttcgtcattgcccaccgactgtccaccgtgcgcaacgccgatgctattatggtgctggagcacggccgcatcgtggagcgtggcagccacgaggagctactggctcaaaagggagagtactaccagctctacaatggcatgtttgaactatcctaa

SEQ ID NO: 1949 - DNA, 2310 bp, Flavonifractor sp.
atgaaaaacgcaaagaaactgcttgcgctgcttcttgctcttgccatgtgcgtgggtgtcctggccagctgttccaacaatgctgaccagaacagcagcgcccctgtgaccgagagcaatcagcccagcgccgagccggccaatgacaccttggtgatcgccgaggacggcatggacggcaagttctcccccttcttctacaccgctgtgcccgatgagacggtggtcaacctgacccagcttaccctgctgggcaccgaccgcaacggcgccatcgtggaaaagggcattgagggcgaaacccgtgagtataacggcaccgactatacttacaccggcatcgccgacctggagaccgtggtcaacgacgacaacaccgtggattacaacatcaccctgaaagaaggcgtgctgttctccgacggccatgagatgaacattgacgacgtgatcttctctatgtacgttctgtccgaccccacctatgacggttcttccaccttcttctctctgcccattgaaggaatggaggcttaccgttccggtatgagcgtcatgtatgaagtgattgcgaatgctggccgggacaataccgatttcacctactggaccgaggaacagcagacccagttctggtccgaggtggatgctgtgattgagccttggattcaggagatcgtagattactgtgtggctgctggtgcagtagctgagggagccaccattgctgaggccgccgctcagtggggatatgccgacttggctgccgacgccactgctgtggacttcttcaacgccatcattgccaagtatcccacttttgtagaagccgtgcagaccgagagcgccggctccaacttctttgagatgatggagagctttaactccctgtggagcactggtgttgagaccggcgagtccgctcccaatatctccggcatcgagcgtactggcgactactccatgaccgtgcatatgacccaggtggacgccaccgccctgctgcagttcaccctggtggttgcccccatgcattactatggcgatgagagcctgtacgactatgacaacaactccttcggctttaccaagggtgatctgtctgtcgttcgtgaagtgaccggttctcccatgggcgccggcccctatgtgttcaacagctatgagaacggcgtagtatccctgactgccaaccccaactattggaagggcgagcccaagatcgcccacatcaacgtccagtttaccgctgaggccgacaagatttccggcgtgtcctccggcaccctggatattgccactccctccttcgatctggacaaggtggatgagatcacctccatcaatggcaccgaggattttgacggccccgtgatcaccatccgcaccacccagtacctgggctatggctacatcggtatgaacgccgataacatcagcgtgggcggcgatcctgggtctgagcagtctaaggacctgcgcaaggccatcgccaccgtgctgtccgtctaccgtgacgtggtgatcgactcctactacggcgagtatgccacggtcatcaactaccccatctccaacacctcctgggccgctccccaggtcacggacgagggctatcaggtggctttctccgtggacgtgaatggcaatcccatctataccgacggcatgacggacgacgagaagtacgccgccgccaaggaggccgctctgggctactttgaggccgctggctacaccgtggagaacggtaagatcactgccgctcctgagggcgctaagatggagtatgagattgtggttcccggtggcggtattggtgatcaccccaactttatgattatctccatggccaaggacgccctggctgagatcggcttcaatctgatcatcaatgacgtgtccgacggcaccgtcaccattggcaacaatctcaacgccggtacggccgagctgtggactatggcttggtccgctactcccgatcccgacatgacccagatttactactccgacgtggccaacggcggcgccaatgccggcggtagctctcactactatggcatcaaggatgagaacttggacaacctgatcatggaggcccgcgcttctctggaccagacctaccgcaaggttctgtacaaggagtgcttggacatcatcgctgactgggcctgcgagatcccctgctatcagcgtgtggactgcaccgtgttctcttctgagcgcgtcaataccagcaccatcaccccggacatgactccgttctggggctggatcaacgaggttgagctgctggagttgaactaa

SEQ ID NO: 1950 - DNA, 2253 bp, Flavonifractor sp.
acggatgggctggccgccgcatcgggcggcgtactgggcggcatattggcggaggcgtttcaatttgcattcagtgaagtgggcgcgatcgtggtgctgctggtactggccttggttgcagcgctgtgcgcctgtcagatcacctttgccgacatcatagattttttccgggaaaagaaggacagccgggtggaatacgacccggaggactatgagcaaccggagcgctctatccgccgggagcctgccaagcccgcgcccagcgcccctcagaccaggcgaacggccattgatatcccggtggacgacggtccgctgattcaaaaaaagcctaccaccccggtgaccacggtgcggaaaaagaaactttttgaccgcctttccggggtgaccaccccggaccaggtggtgactgggaacacggccccggcgatggaggcggaaaaaccggaatacgaggatgtgcccgagctgaccccggccatggacagcctgccggagaaaaaaacggcgcagcggcagcctgaccccacgcccgcggttgaggaagtccctctccctccgcccatcatccgggagcctgcggttcaaaaggtgtctcgggatgaggcgcgtcaggctggcgatcaggtggcgcgggagattgaggaaaacatggccgaggagccaatcgcttatcgctatccgcccctgtctttactgtccgaggggacgggccaggcggggggagaggccctcagtgagctacacgccaaccagcagaggctggaggacaccctccagtcctttggggtggatgcccatatcgtcaacgtcacccgggggccctcggtcacccggtatgagctggcgctggagcagggggtcaagctcaataagattaccaacctgtctgacgacattgccctggccctgggggccgccgcggtgcgcatcgcccctattccggataaaatttccacagtgggcatcgaggtgcccaaccggacggtgacatcggtggccattcgggaggtcatcggctctaaggcgttcaccgacagcccctccaaggtgtcctttgccgtgggcaaggacatcgggggcaactgcatcgtgggaaacattgcaaagctgccccacatgctcatcgctggcaccaccggctcgggcaagtcggtatgcaccaattccttgatcgtatccctgctctataaggccacgccggacgaggtccggctcatcatggtggaccccaagatggtggagctgggggtgtacaacggtatcccccatctgctcatcccggtggtcaccgacccgaagaaggccgcaggcgctctccagtgggcggtgaacgagatgatgaagcgctaccgagcgttttctgaggtgggggccaaggatctagcctcctacaacaaccacgcccgaaaagaagggcgggacaccatgccccagattgtggtggtcatcgacgagctggccgacctgatgctggtggccgccaaagaggtggaggagtccatctgccgggtggcccagatgggccgcgcttccggcatgcacctggtcatcgccacccagcggccctctgccgatgtcatcaccggcctgatgaaggccaatatccccagccggatcgcctttgccgtggcctccagcctggagtcccggatcatcctggacaccaccggcgcggaaaaactggtgggcaagggggacatgctctacttccccctgggctcgggcaagccccagcgggttcagggctgcttcatctccgaggaagaggtggcggctgtggtggactttgtcaaggaaggggcaaccgcccggtacgacgaatcggtcatccacgaaattgagcagcacgcggagaagaaagaaaaggatgccaagggcgtgggtggagcagaccccgccggtgaggattacgacgaactgctccccgccgccattgaggtggtgctggatgtgggacaggccagcgtctccatgctccagcgcaggctgaagctgggctacggccgggctgcccgcctggtggatcagatggaagaaaagggagtggtaggtcccttcgaggggtccaagccccgccagctgcttatcaccaaggagcagtggcaggagatgcagttcaagcagggcatggtggactgcgcccctgagccggcatacagcgagccggtgccggaggaactgccctttgaaggggacgctatcccccagggacgggacgatcccccctttgatgtggatgatatgtag

SEQ ID NO: 1951 - DNA, 612 bp, Dorea sp.
atgaaattttgcagcaaatgcggcgccccttgtgacgaccatgcaaatgcgtgtccagaatgcggtaatatgttttcacaaaatacagccggaccgaattctgacagtcagaatacaaacagcaacccgaatatgaacggtaatccatataatactgcttatggtaacgcaaatacaaacggcaatccgaacatgaacggtaacccgaatatgaatggcaatccatatatgaacaacacaccgaatatgaatccatatcacggtgttactgaaagaagtattccgctttgtattttatttacaatcatcacttgcggaatctacggcatctactggatgatcgtactaaatgatgagatcaatccactggccggagaacctcaggcaacttccggtggaatggttcttcttctttcttttgttacttgcggcatctatggattatattggatgtacaaaatgggagaacgctgcgaccgcatcaacggcggatcaggtaattctaacattctgttccttgtaatcggtattcttggctttggcattatcaactactgcctgatgcaggataccctcaacaaagtagcacgttcacgccgcggaatgtactaa

SEQ ID NO: 1952 - DNA, 1419 bp, Dorea sp.
atgtatacatttctatgctttagtatctttggatatcaagatccggataaaaagcggcagcttttaagacggcagaatgtgttgatgtttatgatccatatcatagcatttttggtaatgtatctggaaacagaagatataaagatgcttgtcttctatcttgcgcaagtggtacttcttggggctactattctgctgtatatcttgatctatccgaaagtatcaagactggtcgttaataatatgtgtatgctcttgtgcattggtctgatcatgttgacaagattggattacgatattgccatgaaacaatttttgattgcggcaggtgctatcggacttagctttatagttcctgtcctcattcgaaagtttaagtttttttcagagtggagaacgctctatgcagttgtgggtattgtgtctcttggtgcggtcgtagtggtaggaagagtttcctatggagcgaagcttggattcgatattgcaggaatcagcgttcagccatcggaactggttaagatcgttttcgtattctttgtagcttccagtttcaaaaaatcactggaatttaaaaacgttgtgattacaacagcactggcagcgtttcaagtattgatcttggttgcctcgaaggatctgggagctgcgcttatcattttcatggtatatctgacgatgctttacgtggcaacaagacagccgctctatatccttgccggtttaggtgcgggaagtgtggcgtcggtagtggcatattatttgtttaaccatgtacgtgtccgtgtgcttgcgtggaaagatccgattgcgacgtatgacaatggaggttaccaggttgcgcagtctctttttgcaatcggtaccggaggatggttcggtatgggactgtttcagggagagccaatgtcaattccggtaagagaatctgactttatctttgcggctattgcagaggaacttggtatcatattcgccttatgtatgacgctgatctgtgtgagcgtatatgtaatgtttttaaatattgccatgcagctgcacaatattttttataagctggtggcactcggacttggaacctgttacattttccagacatttcttgccatcggaggtgtgacgaaattcatcccttccacgggagtaacgattccgcttgtcagctatggcggaagctccttattaagtacgatcattatgttcgcgattatacagggactttatttattaagagaagacgaggaagaggacattgaaagaaagaaaaaagaaaggctacgagctaagagaagcagacagaaaattgaagcaaaaagaagagcgccggcaaatgtcaaagaaggagcaaaaagaagctcgcagagaagacaagcgccgcaaacagaaaaagcgcgcaagaaacaaagagttcgctag

SEQ ID NO: 1953 - DNA, 1308 bp, Dorea sp.
atgaattgtaaaagaaaggaaatatacagggttatgaagaaagtagcgctgcacaatcttggatgtaaagtaaatgcctatgagaccgaagctatgcaggaattgttagaaaaaagcggatatgagatcgtgccttttcaggagggcgcagatatttacattatcaatacttgcactgtgaccaatatcgcagaccgtaaatcaaggcagatgctccacagggcgagaaagatgaatcccgatgccattgttgtggcagcaggatgttatgtccagacggagaaggagcaggtggacgagtgtattgatatcgttgtgggaaataacaggaagcatgatattgtaaagattctggaatcctatgattccgagttgaaaagagagatcattgatatcaatcagaccagggaatatgaggagcttacgctggatcagactgcggagcatacgagggcatatctgaaggtgcaggatggatgtaatcagttctgttcctattgtattattccttatgcgagaggtcgtgtgagaagccgtgcgttggaaagtgttgtaaaggaagtgaaggcgctggcggcaaatggttatcaggaagtggttcttaccggaatccatctgagctcttacggggtcgatacaggagaaagccttttgtctttgattcttgcggttcatgaagtggaagggatcaaacggattcgtctggggtctctggagccgagaatcatcacagaggaatttgcaaagacaatctccggtcttccgaaaatgtgcccgcattttcatttatccttacagagtggctgcaatgctacgctgaagcggatgaaccgcagatatactgcggaggaatattatgagaaatgcgagctccttcggaaatattttgaccatccggcgcttacgactgatattattgtaggtttccccggggagacagaggaagaatttgaagagtccagagcatttgtggacaaagtcagcttctatgagacccatgtattcaaatattccagacgggaaggaacgaaggcggcagtaatgcaagatcaggtgccggaacctgtgaaagcggcaagaagtaaggtgcttcttgaactgaatgaaaagaagcgtgcagcttacgaagagcgtctgatcggaacaacgcaggaagtgcttatggaagagcaaatggagattgacggtatcatctgtcaggtgggacatacgaaagagtatgtgaagattgcatatgagacggaggagaatctgtcgaatcagatcgtagatgtagaaattgagagtcatttgcaaatcaaacattga

SEQ ID NO: 1954 - DNA, 1263 bp, Dorea sp.
atggaaaatcagagaattattcaagttgaggataaagtaccttttaagctactgcttcctctgagtattcagcatatgttcgcaatgtttggagcgtctgtgctggtaccgtttatttttggtatcaatccggcaatcgtgttattcatgaacggagttggtaccttaatttttatcgcggtgacgaaaggacaggctccggcttatcttggctccagtttcgcgtttcttgctccggcgggaatcgttattgctgaaatgggctatgaatatgcgcttggtggttttgttgcagtaggattttgtggctgcgttctttcctttattatttataaatgtgggacagactggattgatattgttctgccaccggcggcgatgggcccggttgtagcattgatcggactggaactttccggttctgcggcaagtaatgccggacttctggatgaaaccatagatatgaaaaatgtgattgtgtttgcggtaacgctcggtgttgctgtctttggaaatattttattccgtggatttttgtcggttattccgattctgattgctgtaattgcgggatatattgcggcgcttgcctgtggtattcttgatttttcacaggtggcagaggcggcatggttcgcggttccgaactttcagacaccgaagttcgatttgggagcgatcatgatgatcctgccggtgcttctggttattacttcagagcatattgggcatcaggttgtgacaagtaagattgtagggcgcgatcttctcaagaagccgggacttcaccgctctttgttcggtgataatttttcgaccatgttatctggtttgatcggctccgtgccaacaacaacctatggggagaatatcggagtgatggctgtaactaaggtgtacagtgtgcgagtgatcggcggagcggcagtgctgtctatcatttgttcctttgtaggaaaactggcaatgttgatccagaccattccgggacctgtgatcgggggaatttccttccttctgtacggaatgatcggagcttcaggtatccgtattcttgtggattcgcaggtggattacggacgctccagaaatctgatgctgacctcaattgtgtttgtgacaggtctgtccggtatcaaagtgaatttcggcaacatccagcttacaggaatggtgcttgcatgtgtagttgccatgattttaagtctgattttctatattcttgataaattgaaactgaccaatgaccgggaagaagcatag

SEQ ID NO: 1955 - DNA, 1680 bp, Dorea sp.
atgttacaacgtttgtatgtaaagaatctcgctctgatcgacgagattgaagttgaattcgaacatggtttaaatatattgacgggagagacgggagcaggaaaatcgattattctcggctctgtgaaccttgccctcggcggcagatacacaaaggatatcattcgcagaggcgctgattacggtttcgtagaacttacttttctgattgaaaaccatctgatagaagagaagttaaagaagatggatattttcccggaagagggctgcgtcattctgtccagaaggctgatggagggaagaagcgtaagccgtatcaacggagagacggttccgatggcgctgttaaaggaagcggcggaggtgttgatcgatatccacggtcagcatgaacatcaatcgcttctgtataagaagaatcatcttggcattgtagatgcttttgccaaaagtcaggtcggtgaattaaaagaagaagtatccggcttatataaaagttaccggaatgcctgcaaagagctagaagaagcagacatggatgaggcgagcagagcaaaagagctttcctttatgcgctttgaggtatcggagattgaggatgcggagcttcgtgaaggtgaagatgaagaactggagtcttcctatcgttttatggtgaacagcaagaagatttcagacggtgcggaagaaacctatcagtatacaagtgagagctcagaaagtgtcagtgaaaatttaagccgggcaatccgtgccctttctgagatccgggaatgtgacgagagagcttcacagctctacgaacagttggtggaagtggacagtctgctgaatgattttaacagagagctgtcagattatacgcagtcctgtcagtgttctgaggaagagttatacgaaacagagacgcgtcttaatgagatcaatcgtctgaaggtgaagtatggaaatagaatcgaagatattttagcatactatggggaaattcaggaaaagattaaaaaattagaagactatgaaaattatgttgcaggattaaagaagcgatgtgaagaagaaaagaaaaagcttattcgctgtgccaggaaattgtctgctgccagaaaagaacaggcgcagattttggaagaagaaatctgtaagggactgcaggaattgaattttgcggatgttaaattcgaaattcattttgagacactgcaggaatgcggtgcttcaggaatagatgatgttgaatttatgatctctatgaatccgggacagccggtaagaccgcttgtgaatgtagcttcgggaggtgaactctcaaggattatgcttgcgatcaagaccgttatggcggatcgtgatgaaatcgagacattgatctttgatgaaatcgacgtaggaatcagtgggcgtactgcgcaaaaagtatcagagaagatggcggtcatcggtaaaaatcatcaagtgatctgtattacgcatcttgcacagatagcagcgatggcagatcagcattatatgattgaaaaagttgtatcagatcagacaacaaaaacggttatccgtggactggatgaaaaagaatctgtggatgaactgtcaagaattcttggaggagcgaagatcacagatgcggtggcagataatgcaagagagatgaagcagcttgcaaaagagattaagaaaatctga

SEQ ID NO: 1956 - DNA, 882 bp, Dorea sp.
atgataaaaagtatgacaggcttcggacgttgtgaggttcaggaagagtcacgcaaattcacggttgaaatgaagagtgtgaatcaccgttatctggatgccaatatccgtatgccgaagaaattgaatttttttgaaacagcaatccgcagtcttctgaagcagagcgtgcagagaggaaaggtggatatatttattacttatgaagatctgtctgaacagcaggtatctttaaaatataacgaagtgcttgcggcggaatatctatcgtattttgaaaagatgcaggagaagttttctctggaaaatgatatccgtgtgtccacgctgtccagatatccggaagtgctcacaatggaagagcaggctgtggatgaagaggaattgtggaagggtcttaagaaggcgcttgacggtgcgattcgtcagtttgtagagacgagaacttcagagggagaacatttaagagaagatctgatcgagaagcttgacaacatgttgaagcttgtaggctgtattgaagagcgatctccgcagattatcgcagagtatcgggacaagctggagacaaaggtgaaggaacttctggcagacacccagatggaagacagcagaatcgctgcagaggtagtgatctttgcagataagatctgtacagatgaagaagtagtgagactgagaagccacattgtacatatgaaggatacgttggtatcggacgacagcggaatcgggcgtaagcttgattttattgcccaggagatgaatcgtgaggcgaacacgattctgtcgaaggccaatgatcttgaaatttctaatattggaattgaattaaagacagagattgagaaggtcagagaacagattcagaatattgaatag

SEQ ID NO: 1957 - DNA, 636 bp, Dorea sp.
cattttaaagaggggattaagactatgaagcatcaggaacaaccgtcaaaagatttatcaaaacagcagctgaaatccatggaaacaaaagcccggattttcaatgccgccaaacggattcttaaaaaaagcggctacgaacaattatctatcaagaatatctgtgaggaagccggtgtttctaatggaagcttttatcaccactttaagacgaaggatgatcttctttcttattatattgaagaacagccaagcatcaatccagatcttcttgatctcccttcctcgaaagaagaagcgcgggaaacgattgtctatgtctatttaaactatgttcgctactgtcgggaactgggtgtggaatttatggcaaactactatactcccaagaaccagtccttaaatccgctgatccgtaccgagcgaccttatccgatcatcaccgtgcacaactatcttcaaaaatgtatcgatgccggaatcatcaccttaagcgattctctggaacacatcaccaccgatatccgtatgatcgttatcggaaatgtatttgagtggtgccttaaaaacggggatgcagatttcgaaggaaatatgcggcgctgccttgaaaattatttaaatggagtattctaa

SEQ ID NO: 1958 - DNA, 1422 bp, Dorea sp.
gtgttatctaaaaatgagatacatgaaggaggaaatcaaatgttagagaagtttttcaaacttaaggagaacggtacagatgcaaagactgagattcttgccggaatcactacttttatgacaatggcgtacattctggcagttaatccaagtattctggctgcagctggtatggatcagggtgccgtatttacagcaacagctcttgcggctttgattggtactttactgatggctgtctgtgcgaattatccatttgcgcttgcaccgggtatgggactgaatgcgtatttcgcatataccgtagtgcttggaatggggtatgactggcaggttgcactgactgcagtttttgtggaaggtattgtgttcatcgttttatctctcacaaatgtgcgtgaagcaatctttaatgcgatcccgaagaatttaaaagcagctgtcagcgtgggaatcggtctgtttatcgcatttatcggacttcagaatgcgaagatcgtaattggcggagcaacattggttgagttattctctcttgaaaattacaatatggcaaatggtgtagaagcaacatttaacgatgtcggtattaccgttgtgctggcaatcatcggaattattatcacaggtatccttgtgatcaagaatgtaaaaggaaatattttgtggggaattcttgccacatggatcatcggaatcatctgtcagtttgcaggggtgtatgttccaaatccggaaatcggattttacagcctgcttccggatttcagcaacggactttctattccaagtcttgcgccggtattcggaaaacttgatttttcaagtgtcttttcattgaattttattgttgttatttttgcattccttttcgtagatatgtttgacacaatcggaacattgattggtgtatcatctaaggctgatatgctggatgaaaacggaaaattgccaagaatcaagggcgcgcttcttgcagatgcaatcgcaacaacagcaggagcggttcttggtacaagtacaacaactacattcgtagaaagtgcatccggtgtatctgaaggcggaagaacaggtcttactgcagtgacaactgctattttatttggactggcactgttcctgtctccgattttccttgcaattccatcatttgcaacagctccggcgcttgtggttgttggattctatatgctgacaaatgtggtaaatatcgattttaacgatatttctgaggcgcttccatgctatatctgtatcggagcaatgccatttttctacagcatttcagaaggtatttctatgggagttatttcctatgtggtactgaatctgttaacaggagaggcaaaagagaaaaaaatcagtatcttgatgtatgtgcttgctgtcttatttattttgaaatatattttcttataa

SEQ ID NO: 1959 - DNA, 1026 bp, Dorea sp.
atggagaagaaaaatatcgactggtccaatatcgggtttggatatatggagacagataagagatttgtttctaactataaaaacggagcatgggacgacggcgtgctgacagatgacgcgaatgtcgtaattaatgagtgcgcaggtgttcttcagtatgcacagacttgttttgaaggcttgaaggcttatacgacagaagaaggtcacatcgtaatgtttcgcccggatctgaatgccagcagaatggcagattccgcaaagagactgatgatgccggtattcccggaagataagtttatagaggctgtacataaagtagtggaagccaatgcagcatatgttccaccgtatggttccggcgctaccttatatgttcgtccttatatgtttggatctaatccggttattggcgttaagccggcagacgagtatcagttccgtgtatttactacaccggtaggaccatacttcaaaggcggcgcaaaaccgatcacaattcgtgtctgtgattatgaccgcgcagctccgcatggaacaggacatgtaaaggcaggacttaactatgccatgagcttgtatgccatcatggatgcgcatgctcagggatacgacgaaaatatgtatctggatgcagcgacaagaacgaaagtcgaagagacaggtggcgcaaattttatctttgtaacaaaagacggaaagcttgttacaccaaaatcttctaccattcttccatccatcaccagacgttctttgatgtatgtggcaaaagagtatttgggtatggaagcagaagaaagagaagtgtatttagacgaacttagtgatttcgcagagtgtggactgtgtggaaccgcggcagttatctcaccggttggcaaggtcgtggatcatggcaaagaaatctgcttcccaagtggaatggatgatatgggtcctgtgacaaagaaattgtatgatacgctgactggaatccagatgggcagaatcgaagcaccggaaggatggattcacagagtatgttaa

SEQ ID NO: 1960 - DNA, 1020 bp, Dorea sp.
atggcagcaagaattttttatcaggaagattgtaatttatctgtattagagggacagaaaattgcgattatcggttacggaagtcagggacatgcgcacgcccttaacttaaaagaatctggttgtgatgttatcgtaggactttatgagggaagtaaatcatgggcaaaggctgaagcacagggattagaagtgttcacagcagcagaggcagcaaaacaggcagacatcattatgattctgatcaatgatgagcttcaggcagatatgtataagaaagacatcgagccaaaccttgaggaaggcaacatgcttatgttcgcacatggatttaacattcatttcggatgtatcaaaccgccgaaaaatgtagacgttacaatgatcgcgccaaaggctccgggtcatacagtaagaagcgagtatcaggcaggaaaaggaactccttgcttagtagcagtagagcaggattataccggaaaagcatgggatcgtgcacttgcttacggtcttgcaatcggtggagcaagagcaggtcttcttgagactacatacagaacagagacagagacagacctctttggtgagcaggcagtgctttgcggtggtgtatgtgcacttatgcaggctggtttcgaaacactttgtgaggcaggatatgatccaagaaatgcttacttcgaatgtatccatgaaatgaaactgatcgttgatcttatttaccagagcggctttgcaggaatgagatattctatttctaacacagcagagtatggcgattacattacaggaccaaagatcattacagaagatacaaagaaagcaatgaaacagatcttatccgatattcaggacggtacatttgcaaaagacttccttgttgatatgtctaatgcaggacgtcaggtacacttcaaagcaatgagaaaacttgctgctgaacatccatcagagaaagtaggagaagaaatcagaaaactctacagctggaacggcgaagataaactgatcaataactaa

SEQ ID NO: 1961 - DNA, 1659 bp, Dorea sp.
atgtcagaaaaagccaaaaaatccggtaagaattttatggtacaaggttctatccttgcgattgccggagtcataactaaaattatcggtgctgtatacagagtaccgcttgttaatattctgggagatacaggaatgggatattacggagttgcatttcagatctatgcaatcgtccttaccctgacgtcctacagtcttccgctggcagtatcgaaattgatatctgccagagttgcaacaaaggaatatcgaaatgccatgcgtgtgttccgcggtgcgttgacttttgcatttgtagtaggtggtactgcgtgtctgattctgttcttcggagcagattttattgcggaaaacattatggcaatgaaatacagtgccattgctatgcgagtgttggcgccgtgtgtgttgattgttgcagttatgggtgttttccgtggattcttccagggaaatggttctatgatcccgactgctttttctcaggtccttgagcaggtggtcaatgcagtggcaagtattgcaggagcatacttccttctgaagctggggaaaaatattgccaagaagcgtggggttcacgcatatagctatgcttatgctgctgccggcggaaccgtcggaaccgttatgggtgcagcgattgcattggcatttttggtgctgatcttccttgcatttcgtaaggtgttccaaaagaaaataaagagagagagaagaggaccggtagagagttatcagagaatcttcaagattctgctgattaccattgctccagttcttatcagtgcaacggtttacaatctgtgcggagtgatcgacaattccatgtacggtgtgatcatgtcagcacagggatttaaagaaagtgaatatgccagttatcttggaatcttaagtggaaagtatgatacggtcattaatgtgccgcttgcattttccaacgcattggcagcgtcactgattccaagtcttgtggcaacggtaaagaccggaagcagaaagcaggtgcatcgcaagattaatacatttgccaagtttgatatgatgattgcaattcccagtgcagtcggactgattgtattggcaaaaccggtactggatctccttttctttacagaagataacaaagaagccgcgcttattttacaattaggagcaatttccgttattttctactgtttgtctacggtgacaaatgcagttctgcaaggactggacaaaatgatgattccagttcgaaatgcagcgatcgcgctggttgttcatgttgtggcactgtttattatgatggttgtatttaaatggggaatctatgcagttgtcgtaagtaagattgtattttccgcgtgtacgtgtattttaaactcgcactctcttcgggatgaagtgggatatgtgcaggaacagaaaaaaacctttgttatccccggaattgcagcactgatcatgggaattgttgcgaaagttgtgcatcttctctttgaattatttgcaggcacacagatcgcaacgctgattgcacttccgattgcggctatcgcatacggaacagcgctgattcttctcggcggagtgacagaggctgaattgaaaacggttccgaagggaagagtattgatctcgttctttaaaaagattcatgtactgaaatag

SEQ ID NO: 1962 - DNA, 696 bp, Dorea sp.
gtgttagcaggtgaacatatgaatggtaagataaatgttttaggaatagagattgacaattacaccgccaaggaaacgatgaagaaatcgattgagtatctgacgacagaaccggtcaatatgatagaggttgctacggtggatgtattgatggacacgaatacagagcttatgctgaaggaacagatgaaggattttgaccttgtactggcaggcgacagaaccgttctggaggcagcagaagtaagcgagagaaagcggcttcaggaaacagatgacagactctatctgcaaatgttcttccgctatcttcacaagaaccacaaacggatctatctccttgtggagtcggaggaagaaggacggcggggctatgaatatctggaacaccgatatggtagtattcaggtgtgcggaatggcgaaggtttccgcgcaggatcgcgcagacgatatgctggtcaatgcgatcaatggtgcagaagttgattgtgtactctcattgctatcttctccgttaagggaagatttcgcggtaaagaataagaatctttttaatgtccggttgttcctgtgccttggaaaaactatgattccggaggaaaagagaagatttggaagtcggaagatcagtcagtttttgacgaaagcattgttcaaaaaagagatagaaaagcaaaagataagaaaatcataa

SEQ ID NO: 1963 - DNA, 1737 bp, Dorea sp.
agtacaaaaaaacaggtagtttttgacactaccgaatcggaaaggaaggtatgtgagatgggatttaaaagtgatattgagattgcacaggaagcggaaatgaaagtaattaatgaggttgcagattcgatcggaataccggataaatatgtagagaattatggtaaatataaagcgaaaattgattatcgctattatacggatgaattagaagaacgaaaagatgcgaagttagtccttgtgacggcgatcaatcccacacctgcaggagagggaaagacaacgacgacgattggccttgcggatgcaatgaatcggctgggcaaaaaaacaatggttgctttaagagagccgtctcttggcccggtgttcggtgtgaagggaggagcagcaggaggcggatatgcacaggttgttccgatggaggacattaatcttcattttacaggagaccttcatgcaattggtgcggcaaataacctgatcgcggcaatgctggataatcatattcatcagggaaatgcactggatatcgacacaaataaagtgacgtggagaagatgtgtggacatgaacgaccgtcagctgagaagtattgtagacggactgggcgcaaaagcggatggtgtgaccagacaggacggatttgacattacggttgcatctgagatcatggctgttttctgtctggcaaaagacgtcttagacctgaaggaacgtgtatctaaaattatcgtggcgtattccagagaggggaaaccggtcacggcaggcgatctccatgcagaaggggctgttgctgcgcttcttaaagatgcgttgaaaccaaatcttgtacagacactggaggggacgccggcatttattcatggcggaccgtttgctaatattgcgcatggatgcaacagtgtgattgcaacaagaatgggaatgaaattatcggattatatgataacagaagcaggattcggcgcggatctgggcgctgaaaaattcattgatattaagtgcagaatgtcaggacttcgtccgaatgcagttgttttagttgcaaccatcaaggcgttgaagtataatggcggtgtggcaaaagcggatctgcagcaggagaatctggatgcacttgagaaaggaatcccgaatctcttgaaacatatagagaatattacaaacgtttatcacctcccggtcgtcgttgcgattaatgcatttccgacggatacgaaggaagagcttgagcttgtgcgtgaaaaatgtaaagagctcggtgtaaatgttgcgttgtctgaagtgtgggcaaaaggcggcgaaggaggagaagagcttgcaaaagaagtacttcgcctctgcgaaggggacagtaccatgaagtttgtctatgatgtggaagcttccgtgaaagagaagattgaagcgattgcgacaaaagtatacggagcggacggtgttgattatacaccgaaggcgaataaagagattaaaaatctggaagcgatcggacttggaaaccttccggtctgcatggcaaagaaccaatattccttaacggacgatgcgaagaaacttggaagaccgagtggattcagaattacgatccgtgatattactgcatccgcaggagcaggatttttggtggcattgacaggagatattatgaagatgccgggacttccaaaagttccgtcagcggagaaaatcgatgtagatgcaaatggtgtgatttctggattgttttaa

SEQ ID NO: 1964 - DNA, 792 bp, Dorea sp.
atgggtgaggttattgtaattacatcaggaaagggcggtgtaggtaaaacaactacaaccgccaacataggagccggtctgtcacagcttggaaataaagtcgttgtgatcgacacggatctgggacttagaaatctggatgtggtaatgggattagagaatctgatcgtctataatctggtagatgttatcgaaggaagctgccgcttaaaacaggcattgatccgggataagagatatgaaaatctctatcttcttccatccgcccagacaaaagataagtcagctatatcaccgggacagatgaaaaaactcacatcggagctaaaggaagaatttgattacatattgcttgactgtccggtaggaattgaacagggattcaaaaatgcagttgccggagcggatcgggcaattgttgtgacaactccggaagtctcggctataagagatgccgaccgtattatcggcctgttagaaaaaagcggcttaaaaaacaacgacttactgatcaatcgtattcgcatggatatggtgaagagaggagatatgatgtctgtcgatgatgtgacagacattctggcaatcccccttctcggtgcgattccggatgatgaacaggttgtcataggtacaaatcagggggaaccggttatcggtcttcactcccgggcaggaaaagcctatacaaatatttgcagacgtattatgggagaaacagttccatttcttaatctggaagcagaaaacagtattttttcaaagctctccgggcttttcagaaaagaatag

SEQ ID NO: 1965 - DNA, 1485 bp, Dorea sp.
atgatagaaataaggattgagggaaagaagatgaggaaacggttgatagcggcgttgttgatcatgctgctatgtatggggatgagcatgacagcttatgcggtcccgcagataacgccggaggagcagccaccggctgaagcaacggaagaagaagcgcaggcatttaaggcggcacagttaaagaaatattatgatatgccggtggcaacgaatgagatcaaagggtggccacagggaccgggaacttacggagaagcggcaatcattatggaggcaggaaccggtgccatcttatacgggaaaaatattgatgatcagcattatccggcaagcatcacgaaagtgctgacggcgctggtggcgctggaaaacggcaagatggatgataaagtgacatttacgcatgactgtgtctcattccttcagcccggagactccagtatcggaatgaaggaaaatgacgagatcacgctggaacaggcattgtatgcaacgcttctggcatcggcaaatgaggcggcttatgctgtggcggaaaatgtgggaacaaacgccggtcacgattatcaatggtttattgaccagatgaatgcccgttgtaaagagcttggcggaaccaattccaattttgtaaatgcaaacggacttcacgatgaaaaccattacaccagtgcaaaggatatggcattgatcgggaaggagctttttaagcatccggagtttttcaagattgtacagacattgcagtatgagatcccgtcatcaggtacatgtcagcagcatgtatttcaacaaaagcataagatgctgcagccttcaagttcgaaatattatgagtatgcggtaggcggaaagaccggctatacatcggatgcactggcgacacttattaccatggcagataatggaagcatgaagcttgtctgtgtcgtgcttcgaacacatgggggaaataattacccggatactaccaatctttttaattatgcgttcgataattttgaacggattgacgtgaatgggcaggagacttcggaagatgtaggagatattctggaagacgagagcggagaacacagtggatatgtagttgttccgaagggtgtgaagttttcagatcttaagatggaaatgacggttgatgagggacataccggagaagcagtgcttacttatacctatgaaggaaatcttgttggaagtgccagagcaaaactcagtgagaaatatctcaaggagcatagagctgagattaagaagcaagaaaagaagacaaagaaagcagatgcatcggatgggaaaaatcttcaacagaggctgatcgttgtgggactggcagttttatttttggtcttaatactgttatttatcgcgaagatcagacaatatcgaagaagactggagagacgtcgcagaagacaccggagaagatcgagccagcagaacagagcagggcagaatccgcgcaggcgaaagaagtaa

SEQ ID NO: 1966 - DNA, 1350 bp, Dorea sp.
atgaagaaagatttgacacaagggaaggtacaaaagacactgcttgtatttgcaggtcccatgattgttgggaacctgcttcagcagtgttataatattgcagacacactgattgtgggaagatatctgggagcaggggcgctggcggctgtaggaacagcttatagtctcatgacctttttaacttccattttaattggactgtgtatggggtgtgggagtatcttctcttattattatggaaaaaaagatgacgggaagatgcaagagagtatgtttacctctttcttattcgtaggtgtgatcgccattgttatgaacgtaactgtatttgcggggattgatgttatcttgaagatgcttcagattccggcagatatatatgggattatgaaagaatatacatgggtggtattctggggaatctttttcgtatttctctataatttttttgcatttcttctccgggcagtgggaaattccctgactccgttattgttccttggcgcggcatctgtcttaaatattgtgctggatttactctttgttgtgagctttgatatgggagtttccggcgcggcgtgggcaactgtatcgactcagatgctggcaggcatcggcatttcagtatatacgtgggtgaaagaaccaagccttcggttcttccgcgtgaataagagggaattttctaatgaaagatggcggaggatgaaagcttcgctgccggaagtgatgcgtttttcgctggcagccagtatccagcagtcggtaatgaattttggaatcttaatgatccagggactggtgaacagcttcgggacttccgttatggcagcattcgcagcggcggtcaaaattgattcgtttgcctatatgccggcacaggaattcagcaattccttctcaatctttacttcccagaattccggggcaggagataaaaaaagagtccgagaaggagtacgcacctctgtaaaactgtccatcagcttctgtctggtggtatcggtgttgatctttatcttcgcgaagtatttgatgatgatctttgtgcatcctgaagagacggaaattatccggatcggtgtagagtatcttcgaatcgaaggaagtttctactgcggtatcgggcttctgttcctgttctatgcttactatcgtggaatcggaaagccggagatgtccgtagtgctcacagtgatctcactgggaacccgtgtggcgctttcctatgcactggctccaatcctgggcgtgcgggtaatctggtggtccattcccatcggatgggcgctggcagaccttacggggggagtatatatgaagaagttggtgaagaaaagtaaataa

SEQ ID NO: 1967 - DNA, 1377 bp, Dorea sp.
atgtataaaattgattttacacaaccggtacacgttcactttataggaatcggcggtatcagtatgagcggtcttgcagaaatccttctgaaagaaggctttacagtctcaggttcagacaacaaggagtctgcgctcaccgatcagctggagaaagccggcgccaaagttttttataaacaacaagcttctaatattatagatggaattgatgttgtcgtttatactgctgctatccacgaggacaatgaagaataccgcgccgcactggacaggggacttcctatgttgagccgcgcagaattattaggccagttaatgacaaactatcagattccgattgcagtttccggaactcacggaaaaaccacaactacatcgatgttatctcacattttattaagcgctgatcttgatcctaccatttctgtaggcggaatcttaaaggcaatcggcggaaatatccgcgtgggaaattcagaagtatttctgacagaagcatgtgaatacacgaatagttttctccactttttccctaagatcagtgtgattctcaacattgatgaagatcacctcgactttttcaaagatctcgatgatatccgcagatctttccgcaagtttgcagagcttcttcccgcagacggcactctggtgatcaacggtgaaattcctgatcacgaagaattgacagaaggactatcctgccatgttgttacttacggtccggatacttcctttgattacagcgcagtgaacattgctcacgatgcatccggatgcgcttctttcgattttgtaaaacacggagaatttgtaacccgcatttccttatccgtcaacggcgaccacaacgtatccaatgcgctttccgccctcgccgttgctgatattttgaagatttccgttcaggacgccggggcaggactgaaagatttccacggcacaaaccgccgttttgaatacaagggcgaatttaacggagtgactgtcattgatgactatgcccaccatccaacggagatccacgcaagccttgctgctgcaaaacactatccacaccgtgaaatctggtgcattttccagcctcacacttatacgagaacaaaagctttattcccggaatttgtggatgcgttatcacagacggatcatgtgatcttagcggacatttatgccgcacgcgagacaaacaccctcggcatctcttcgagagatctcgccgaagcattaaaagaaaaaggcgctgacacttactatttcccttcttttgaagagattgaaaacttctgcctggaaaagtgtcaaaaaggggacttgttgataactatgggagccggagacgttgtaaacattggggaaacgctcctaaaataa

SEQ ID NO: 1968 - DNA, 1287 bp, Dorea sp.
ttggactcgggtgacgtcacgcagcttattattttaattattctattaatgctttctgcttttttttcatcagcagaaactgcactgacaacagttaacagaatccgtatccgcagccttgctgatgatggaagcaagcgcgcaaaaacagttttaaaaataaccgataattccggtaaaatgttaagtgccatattgatcggcaacaatattgtcaatgtagcagccgcctctattactacaagtctggcttacagtcttggcggttctgccgttgcaattgccaatgcggtaatcacgattgcaatcctcttatttggagagatcacaccgaagactacagcgacaatccatgccgaaaagctggctcttatctacgcaccgatcattagtatatttatgaagatcatgacacctgtgatctttatcatcaacggtttatccaacgcggtgctcctgcttctgcgcattgatccgaatgctaagaatcagacaatgacagaaaacgagctccgtaccatcgtggatgtcagccatgaagatggagtgatcgaatcagacgagaaggaaatgatctacaatgtgtttgacttaggcgatgccaaagccaaagacgtcatggttcctcgtgtacatgtaacatttgcagacgtaaacactacttacgaggaattaattgaaatcttccgagaagataagtttacaagacttcctatctttgaggacagtaccgataacgtcatcggtaccattaatatgaaagacttactgttatttgacaatacgaaggaatttcatattcgagatatcttaagagaagcttatttcacttatgaatataagaatatctccgaacttttagtagaaatgagagaagcttcctttaacattgcaatcgttcttgatgaatatggtgacaccgcaggtctcattacactggaggatatcctggaggagatcgtaggtgaaattcatgacgaatacgacgaaaatgaagaagacttcatcaaagaaatcggcgaacgcgaatatatgattgaaggctctacgaatttggacgacttaaatgatcgtctggatcttcagttggaatcggaagactacgattctctcggaggctttatcattgaacatctggaccgccttccggaagaaggggattctatcactaccgaagacggacttcgccttgtggtggaatctttagataaaaaccgaattgaaagcgtacacgcttacttaccggaaccgtctgtcgagaccgaagacgatgattccgacaattaa

SEQ ID NO: 1969 - DNA, 774 bp, Dorea sp.
atgggcagtttaattctatgtcataaaaaacgtgccaaacaaccctatatgattacaagggttcatatcagaatctacacgattgaagagctgtgttattatatctgcaataacctctatctgatcgattatacactgatgaaccgtcagctgtgtgagtggattcgagaagagctgcatatgtgggggctggcggatcagcttttgggacagatggaaaaaaactgtactgccgagcagtttgtgcttactattttggaaaagtcgaatgtctattcactgggtgaggtcaacaaagttcaaaatatgttggagaagcttcagaatcaaaaagatgtggagcgtgcaaaacacaaagcggacagtctgcttgcaagcaaagagtatgcgcttgcggttcttgtctatcaatcaattgtcaaaaatgaatgggatgattcggtagataagagcttttacggaaaagtatatgggtgtctggggaccgcgtacggacaacagtttttgtatgaagaggcagctgctgcatacaaggaagcgtatcggctgagcgaagacccggagatgctgaaagcttatatgtattgtgcgtatcgttctatgccggaagcagagtatgtaaagatgctgtcgggaaattcagtatatctcagtatggattctcttctgaaagaagaattgaagcaggcacgcagaagcgtagatatggatgtgacggatgaaaaactggaaatatggaaaaaggaatatcgcaggattgacaagtgctgctag

SEQ ID NO: 1970 - DNA, 705 bp, Dorea sp.
gtgataaaaatggctaaaatattagtatgtgatgatgacagagaaattgtagaggcgatagatatttatctgacgcaggaggggcatgaagttttaaaggcgtatgacggagaggaagcgcttaaggttttaaaggatcaggaggtagaccttctggtaattgacgttatgatgccaagacttgacggtatccgtgcgacgcttaaaattcgggaggaaaataatattccgattattatcttatcggcaaaatcagaagatgcagataagattcttggattgaacgtaggagcagacgactatgtgacgaagccatttaacccgctggaactggtggcgcgggtgaaatctcagcttcgaagatatacacagcttggaagtacggctgcaaacaaaaatgaagcagtctacacgaccggaggcttaatggtaaaggatgatctgaaggaagtcagtgtggacggagagccggtgaaaatgacaccgatagaatataacattttactccttcttgtgaaaaatcaggggaaggtattttcgattgatcagatttatgaaaatatatggaacgaggatgccataggagtggataatacggttgcggtacatatccgacatatccgtgaaaaaatcgagatcaatccgaaggagccccgctatctgaaggttgtgtggggaatcggttataagatagaaaaattatag

SEQ ID NO: 1971 - DNA, 882 bp, Dorea sp.
aagatggataaaataaaattaaaagcactgggcaagatcaatcttggtctggatgttcttggaagacgtccgaacggttatcatgatgtccgcatggttatgcagacggtgtatctctatgatcagattctgttggaaaagacagataaggaaggaatttctcttgagaccaatcttttttatcttccggtcaatgagaataatctggcttatcgcgcagcgaaaatgttgattgatgagtttgctataaaagaaggcgttcatatttctctggagaaacacattccggttgcggcaggtatggcaggaggaagctccaatgcggcagcagtgctctatggaatgaaccgtttatttcagctgggacttacagaccaggaattgatggatcggagtgttcaactgggagcggatgtaccgtactgtattatgagaggaactgttttggcagagggaatcggcgaaaaactgacgccgcttccggcgatgccgaagtgccatgtgctgttggcaaaaccgcctatcagtgtatcgacacagaaggtgtacgagaaactggatgcgcaggaagtgacaaagcatccggatattgacgggattcttcttggacttcagacaggtgatcttgagaagattacttccagtatgggaaatgtattagaaaatgttaccattacggaatatccgcagattgagagaatcaaagacgtgatgaaagaagaaggcgcgttaaatgccatgatgagtggcagcggtcctacggtcttcggtatttacgatgataagatgcttgcgcgccgcgcggctgcaagaatcagagaagaacagcttgcaaagcaggtgcatgtgactactatgcacaatgcgaggaggaaatcatga

SEQ ID NO: 1972 - DNA, 1236 bp, Dorea sp.
atgcagattacagcgacacaattggaacaagttaacaaacaaatacaggcactggtgtctgcagaaagtttctatggaaagaaattagaagatgccggtatctctggcgtgtcttccccggaagattttacaaagctgcctttttcagagaaaaatgatcttcgggaggcctatccacttggacttatgaccgcgccggaagaaaaaatcgtccggattcattcttcctccggaacaaccggtcttccggtcatcatcccgtatactgccaaggatgtagaagactgggctgtcatgtttaagcgttgttatgaaatggcagggataacgaatcttgaccgtattcagatcacccccgggtatggactttggacagccggaatcggctttcaaaatggtgccgagaagctcggagctatggtcatccctatgggaccgggtaatactgacaaacagctgcaaatgatgctggacatgaaatctaccgttctttgttctacctcttcttacgcacttcttctggctgaagagattgaaaagcggggaattcaggatcagatccatctcaaaaaaggtgtaattggttctgagcgctggggcgaaaaaatgagaaagcgtatttccgaagaactgggaatagagctctacgacatttacggtctgacagagatctatggtccgggtatcggagtcagttgcaaagaagataacggtatgcactactgggacgattacatctatatcgagattatcgatcctgtcaccttaaagccattgccggacggtgaacttggtgaagtagtcatcaccacccttgtgaaagaaggtgctcctctgatcagataccgtacacatgacctttcccgcattcttccgggcgaatgtgcatgtggaagcaaatatccccgtctggatgtcataatgggacgaaccgacgatatgatgaagatcaagggtgtcaacgtattcccaagccagattgaggaaatactcaaagacttcccggaagtatccagcgaataccagatccgaatctcccatctggacggaaaggatacgatgcgtatttatgtagagacaaatggaagtgtcgatttcttagatttagcaaagagaattgctgtaaccgtcaagcgccgcattggttttactccgcttgtcaaagttgttgagctgggactccttccgagaagcgaaaagaaatccaaacgtgtaattgatgaaagatacgaatag

SEQ ID NO: 1973 - DNA, 801 bp, Dorea sp.
atgaaagacagagaaagaaaggaagagacgattatgacactgttagaagtaaaaaatgtaaggaaaatatatacaaccagattcggagggaatcaggtggaagctcttcataatgtgaacttttctgtggagcagggagagtatgtcgctattatgggagagtccggttccggtaagacaacgcttcttaatatactggcggcgcttgatacaccgaccggaggaaaagtctatttgaaaggaagagatctaagtggagtcaaagaaagagaaattgcggctttccgccgtcagaatctggggttcgtgtttcaggactttcatcttctggatacgttttctctcaaagataatatcttccttccgctggtattgtccggtaagacatatgaggaaatggagagaagattaacgccggtggcagagagacttggaatcacggagattttaaataagtttccatatgaggtgagcggcggtcaaaaacagcgtgcggcagtagcaagagcgcttgtgacaaaaccgcagcttattcttgctgatgagcctacaggggcgttagattccagagcttcggatgagcttctgaacctgtttggcgcgatcaatcaggacgggcagacgattcttatggttactcatagtgtgaaagccgcaagcactgccaagagggtattgtttatcaaggacggagaagtgttccatcagctctatcggggaaatcttaccaatgaacagatgtaccagaagatctccgatacgctgacagcgcttactacagggggtgaaaagattggctag

SEQ ID NO: 1974 - DNA, 1539 bp, Dorea sp.
atgaacaaaagcaattccttatgggggaagtgtatcttagcgatcgcctgcatgattttgtgtgcgggtatatacggtgaggaggcacatgcagaagaggtgtctttgaagaggggagaagaagtgttttatgaagggtattctacattttattattacataaatggtaagcttggctactgtctggaaccgaaaaaatcttctccgcatgacggaacatttcaggcagagcttctggatgacggaagcctgatcagtaaagccctttattatttatataatggaccgggctatgaaacatatatgaaaccggcttttccggaagcttggaagaaagcagatcaggcatattgtctgtcgcattgtattttgtcttatatttatgatggatgtgatcgaaaaagtgatgcctttttagggttaagcaaacctatgcaggaacttgtcattgcatgtacagagaaggtacgaagtctgccggatgttccaagcccgggaatgcagttttctaaaacggaattgaatgcctattttgcatcggaggagcgtgtgcagagaacgggagagctgatctgtcacggagataaaagtaacactctggagcttacacttccgtctggcgtatcacttgttaataagactaagggaacaacgaagacggggaaggtaagtgtttcgggagaggatgttatatattttacagcagatgcagcggattataatggaaaaagctggaaaacaggaaatttgtacggaaagaacaggcaaaaatggaggagtctggttgtaagtaccggaagcgacggacaacatcttggaacgggcgagcttatcgaagccaaagaaccgccgaccgctctgtcaatcacatggataccagaaggagaggtggagattgataagcgggcagataaatcagataaaaaatttcaagtgggagatatcatcacttatacgattgatgtgacacagcagattgagcatgcggttgccaaaaatgtagtgatcacagatacaattctgaccgaaggggtcaaacttcagaaaaattctattgttctattagataaggatcaaagcattgtgtcagatgcagttatttcagttcaagggaattcttatacgattcatgcaggggagtttttgcagagcatccatacaggagaaaaatatacggtagagtatcaagtcgtgatcacggatgaatctgtgatcggaaaagaaattcataatcatgtcattgtccgaagtgacaattgtgaagaaaaagaagatgaggaaaaggttgaagtggaagagccgaaggaagagccggaagagccgaaggaagaaccgccaaaagaaccagaggaaccggaagagccgaaggagccggaactgcctgtgccggaggaaccggaagaaattacacgaaaagtggaaaaaaccgctccggtaaagaccggagatgaagggaacttgatggttcttattgtaatttccattctttcttgcactgtattatttatctgtggtagaatatcacgtaagactaagtaa

SEQ ID NO: 1975 - DNA, 1152 bp, Dorea sp.
atgaaaaggagaaaaggtagaatggataatttattcatgataagagagaaagtcagagaactgtatgcaagtcattccaaaatttttgacaaggcgattcagtttgttgttgcatttctcacattttatatgatcaacagcaatgtaggatttatgaagatggctgcttcaccgttggtgacattggctctttcggtgatctgtacattccttccgatgacactgactgtcattgcagcgtctgcgcttatgcttgcgcatatgttttcagtgtccctgagtgtatttatagtgaccgcgcttgtatttttgatcatgtatattttctattttcgactggcgccgaagatggcacttgcacttttgctgactcccatcgcttttatgttgaaaataccatatgtgattccggttgcatacggactgatgtctgttccggtttcccttgctgcaatcagctgtggaacaatcatctattatattatgcagtatgtgaaaaaagcagcgcctggtctggatggaaagggcggtgcaggattacttgcagaaatcacagcttatctgaaacaagtgttccagaataaggaaatgtggattaccgttatcgcttttatcatttgtcttcttgttgtatatacacttcgtcgtcaggcgatggattacgcatggaaggtggcaacggcagccggagtagttgttaatattgtagttattgcggctggtggaatcgcaatgggagtacatacatcatatggtcttttgtttgccggtaatatcgctgctgctgttgtgggactgatccttgaacttttctttttcgccgtggattatgcaaaaagtgagaatctgcagtttgaagatgatgaatactattattatgtgaaggctattccaaaactgtcagttgcgtctccggaaaagacagtgaagaaaattaatgaacgtcaagagacagagattattgatacagcggatgtaagaagaaaaaatcagcgtccggaacgtgcaccaaaacgcggaagaggcggcgaggtgccgaaaaaacgtcctgaagcaaaaaaagctccaaaagcaagaaaacacgacatggacgaagtgaataagatgcttttgacacagagcttaaaacaggatctgaatatcagagattaa

SEQ ID NO: 1976 - DNA, 1059 bp, Unknown
  Description of Unknown: Firmicutes sequence
atgaaaaaagaaacattcaatctggtcgtccgctttctggtgggcctggcgctgtcgctgctgatctgcgccggtatgatcatgacgggaaagctgggcagcgacaagcctctgctccagcaggccagcggcctgaagggcacggaaacggtgatgaccgtggacggcgagccggtggagtcctgggagtacctgtatatggtcacttactcggcccagaacctgtcctattacggcgtcaccgatctgagcacgcagctgggcgagggctttaccgccgccgactacgtggcacagcaggcggaggctcaggtgaagcagcaggccgctgtccggaagtgggccaaggatatgggcatcacgctgaccgaggatgacggagccaccctgcagcagcagaaggaagcctacggcgaggatctgcagaaggtattgcagatcaacggtctcacggaggagcagtatgaccagctgatgagcaccacgctgctgtataaccggctgtacgccgcctattgcaccacggatggcgcgctgcgtcccagcgacaaggatctgctggcgctggcggaggagcatagcctgatgaccgccgacgtgctgttcatcagcaccgccgagctggacgacgccgccaaggcggacgccaaggccctgatgggcgattatgcccgccagttgtccaccgccgacgacaaggccgccgcctttgccgcgttggaggcaggggagaacgtgaccgttctggccagcaacacctatgacggctgcgacgagaccacgctgaacaaggcgctggccgcactggcggaggatcaggtcagcgacgttatcgaggatgagaccggctactatgtggcgctgcgccgcgctgtggatctgaacgccgtggccgagatggcctttggcgaggatctgtccgcccgtatctccggcgcacaggtggagcataacgacagcgtgtacaacgccattgacctgacgtccttctacgcccgctataccgccggccagcagaagctctatgctcaactgacagcggagcagccgcagggctaa

SEQ ID NO: 1977 - DNA, 1269 bp, Unknown
  Description of Unknown: Firmicutes sequence
atggagcttctggagaagctgacgatcctctcggacgccgccaagtatgacgccgcctgcacatccagcggcgtcaagcgcagctttcagccggggaaaatcggcaacacgtcctcctccatcgccgggtgctgtcacagcttttccgccgacgggcggtgcattacgctgctgaaggtgctgatgacaaactgttgcgtctatgactgcaagtactgcgtcaaccggcgctccaacgacgtgcagcgcaccgcattcacgccccgggagttggctgagctgaccatcggcttttatcggcggaattatattgagggactgtttctctcctccggtgtgctgcgcaatgccgactataccaccgaacagatgatccgcgccctgcgcattctgcggcaggactatggcttcaacggctatattcacgccaaggccatccccggcacgtcgccggagctggtgcagcagctgggactgttggccgaccgcatgagcgtcaatatcgagctgccctctcagcagggattgcaaacgctggcgccggataaatcgcgggaagcgatcctgcggcccatggggttgatccgggacaaggcgttcgagagccgtcaggagctggtcaagtacaagcacgcgccccgctttgccccggcgggacagagcacccagctgatcgtaggcgctacgcaggacaacgaccggcatatcctgcgcttgacggaggcgctctatcagaaataccggctcaagcgggtgttctattccgcctatgttccggtggtggaaaacagccttcttccctctctggataccaagccgccgctgctgcgggagcatcggctttatcaggcggactggctgctgcggttctatgggtttcaggcctccgagctgctggacgaggcgcacccgaattttgatccgcagctggatcccaagtgcagctgggcggtaacgcatctggagcagtttccggtggaggtcatgcgggcggattatgaaacgcttctgcgtgtgccgggcgtcggccccaccagcgccaagcgcatcgtctccgcccgccgcacggcgcaccttcgatttgaagatctgaaaaagctgggggtggtgctcaagcgggcgcagtttttcctgctttgcgatggccgcgccgcgccgggactccatttttcacccgctaccctcgtgcagcagctgaaggccgtggagcgcggcgcgctcccctccggggaaatggaacagctatcgctgttcgacgcagttggataa

SEQ ID NO: 1978 - DNA, 729 bp, Unknown
  Description of Unknown: Firmicutes sequence
atgagaaacgaagaatttttgaggacggaaatgattctggggggcgacgcgctggacaggctgcgccgcagccacgtggcggtgttcggccttggcggagtgggcagctatgtggtggaggccctgtgccgggcaggcgtgggtgagctgacgctgattgacggcgacaccgtgtccgtcaccaacatcaatcgccagctctacgcgctgcactctaccgtgggacagcctaaggcggaggctgccgccgcccgatgccgggatatctgcccggacacggtggtgcatcccatcgtgggcatctacgacgccgcccaccgggaggagttctttgccgcccaatatgactacatcgtggacgccatcgatctggtcagctgcaagctggatctgatccagcaggccagagagcgccgtatcccgattctgacggcgctgggcaccggcaataaattgcagccggagctgctgaccatcaccgatattgccaagacctccggctgtccgctggcacgcgtcatgcgcaaggagctgcggggacggggcatccaccacctgaaggtggcgttcagccccgaacagccgggccagacccagcagctggaaacgccgccgccgggacggcgcagtgttccggccagcgtgtcgtgggtgccgccggtggcgggattgctgatggcgggcacggtggtgcaggatcttttgaacggaggagggctgatcccatga

SEQ ID NO: 1979 - DNA, 1734 bp, Unknown
  Description of Unknown: Firmicutes sequence
actgctatcttctttcatttcctttcgctggaagccgcggcgcgtatgccgcggcttttggccgttctgagaatggcggcgcagacaaaattatatccccccacccggcttgcggggcggaggaatatctgctatgctgggcacagaaactacgagagaaaggaaatcacacccatgaccatgatgaaacgactggccgcgctggtgctggcgcttgccatgctgctgacgctggcggcctgcggcggagacaataccgacgggaacgacgtccagagcggcggctccacgctggtgtacggcagcggtgactatacccgcatcaaccccaccatggacgagcacggcgagatcaatgtgctgctgttcgacggccttaccgaccacgacggcgacggacaggtcattccccgtctggcggagcgctgggattacgaccccgacacgctgacctataccttctatctggcgcagggcgttacctggcacgacggccagcccttcaccgccgaggatgtgaagttcacctatgaggccatcatggatcccgacaacggctccgagaacgcccccaactacgaggatgtgacagatatcaccatcatcgacgaccacacggtgtcctttaccctgtccgccgtcaacacggcgtttctggagtacatgaccatggccatcctgcctcagcatctgctggagggggaggacatgcagacctccgatttcttccgggctccggtgggcaccgggccttataagctggagagctgggacgtgggccagtccattacgctggtgaagaatcccgactatttcgcgggagcggccaacatcgacaccatcgtgttcaagatcgtcaccgattccaacgccaaggccatgcaactgcaaaccggcgagctggatctggcgcaggtgacccccaaggacgccgcgtcctttgaagggaaagcgggttataccgtctatgacatgaccacctccgactaccggggcatcctgtataacttcaacaatacctactggcaggagaacgccgacctgatccccgccatcagctgcgctatcgaccggcaggccatcgtggacgcggtgctgctgggccggggcgaggtggcctacagtcccttgcagcggaacatctacaacgatcccgacgtggagcgctgggactatgatcccgcccgtgctgagcagctgctgaccgaggcaggctgcaccaaagacagcgagggcttctggcagcgcagcggccagcgcatcggctttaccatcaacgcttcgccggacgatcaggtgcgcatcgacatggcgcaggccgcggcccagcagctgcgctccatcggccttgacgtgcaggccgccatccccgccgagggcatcgactggggcgggcaggagtgctgcatcatcggctggggctccccctttgacgccgacgaccacacctataaggtgttcggcaccgacaagggcgccaactactccggctactccaacgcacaggtggacgaggcgttgaccaaggcccgccagaccgacgatcccgcagagcgggcggcggcctacgacgaattccagcaggcgctggcggcggctccggcctataccttcttctgctacatcgacgccatctacgtggcggcggacaaaattcagggcattacccccgacacagtgctgggccatcacggcgtgggcattttctggaatatctgtgattggacggtctga

SEQ ID NO: 1980 - DNA, 777 bp, Unknown
  Description of Unknown: Firmicutes sequence
gtgctgcgccgtctcttttccattttcctgccgcggttggtgatgttttctttacaaatgggtagaatggtggtatacttctcctgtatgaccaccgcgaaagagaggacatctatgggaaagctgatcgtttttgagggaaccgacggttccggaaaggccacacagaccgagcttctgtgccagacgctgacggagcagggcgttccgttccgccgcctgtccttcccccggtacagcgaggaatcctcggcgctgatccggctgtatctgggcggcgcgttcggcagccatcccgatgatgtgaacgcctacgccgcgtccaccttttacgcggtggatcgctacgcctcctataagcaggactggggcgaatactaccggcagggcggactgctgatcgccgaccggtacaccacctccaacgcggtgcaccagacctccaagctgcccgaggcggaacgcaggccgtttctggactggctgttccacttcgagtatgacctgctggagctgccccgtcccacacgggtgctgtatctcgacctgcccacggagctgagcgagcagatgatgcgccagcgggagcaggccacccacaccaccgccgacgtacatgagcaggatgaggaatacctgcgccgctgccgggagaacgccgcgtttgtgacggaatactgcggctggacaaagatcgactgtgccagagacggcgtgatgcgcagccgcgaggagatccatgccgaggtgctggacaagctccgcggcctgctgtaa

SEQ ID NO: 1981 - DNA, 1599 bp, Unknown
  Description of Unknown: Firmicutes sequence
atgctgaagcttttgctgaaaaagcagctgatggaagtgttccgcagctacttctacgacgcgaaaaagaacaaggcccgctccaaggggacgaccatcgcctatatcgtgatgttcgtgctgctgatggtgggcgtgctgggcggcatgttcgcggtgctggccaacgttatgtgcggccagctggcggagatgggtctggactggctgtacttcgtcatcatgggcatgatggcggtgtttctgggtgccttcggcagcgtgttcaacacctattcggggctgtatctggccaaggacaacgacctgctgctgtccatgcccattccggtgcggatcatcatggcgtcccggctgctgaatgtctatctgctgggactgatatactccggcatcgtgattttgccggtcatcatcgtgtactggtgcaccgtgccccttacggcggggatcattctgggcggcgtggtgctgctgatcgtcatctcgctgttcgtgctggcgctgtcctgcgtgctgggctgggtggtggcgaaaatcagcctgaagctgaagaacaagagctttatcacggtgctggtatcgctggtgtttttcgggttgtactatttcgtctgcttccggtctcaggcgctgatcggcagtctgctgctgaatgccgccagcgtcggtgataagatcaagggcagcgtctatcccctgtacctctttggccgggtgggctgcggcgacggcgtggcgatgctgatcgtctccgccgtggtgatcgccctgctggcgctggtgtggtatctcatcgcccgcagcttcctgaacatcgctaccgcctccggcaataccgccaaggcggtctatcgggagaaggccgccatgcagacttcccctgccgccgcgctgctgcgtaaggagttgggccgattcaccgccagtcccctctacatgctgaactgcggtctgggcacggtgtttctgctgattctggcggtggcggctcttatcaagggacgtgaggtgttcctgatgatgaacgccctgttcgccggaagcgaggacttcgtgccggtgctggcggcgctgtgtctgtgcctgctggcaggcagcaacgacattaccgcgccgtcggtgtcgctggagggcaagagcctgtggatcgcccagtcgctgcccatcaacccgtggcaggcgctgcgggccaagctggggctgcacctgctgatcacggagctgccgctgatgctgtgcgccgtgtgcgtggcggcggtgtccggtctggacttccttcacgcggcgctggtggtggtcatccccatggtatacgtggtgctgtccgccgccttcggcctgttcatggggctgaagcggcccaacctcacctggaccagcgaggtggctcccatcaagcaggggttggcggtattcctgtccatgttcggcggttgggtgctggcagcgggactgggcttcctgtactacgccctgatggctcatttgggcgcggcggcgttcctgctggcggccacggcgctgattatcgtgctggcgctggtgctgctgcggtggctgaaaacctccggtgcgaaaatctatgcgcatctgtaa

SEQ ID NO: 1982 - DNA, 942 bp, Unknown
  Description of Unknown: Firmicutes sequence
atgaaagacatccgccgcgttgccatcgccggtgccggcaccatgggttactcgctggcccaggcattttccgccgccggatacccggtgaaactctatgacctgttccccgccgcgctggacaaggcgcgggacatgatcgccctgaaccagcagaccgaggtgaccagcggcaagctgacggcggagcagtccgccgccctgattgggcgtatctccctcacctcacagctggaggatctggcaaacaccgattttctggtggaggccattctggaaaagctggaggtcaagcacgatttctaccgccagctgtgcgccgtcgtggcggaggacgccatactgtgcagcaatacctccggattgagcatcaccaaaatagccgaggccgtcacccatccggagcggttcgccggaatgcactggatgaatccaccccatattattcccctcattgaaatcgtggagggcgaaaaaaccgcgccggagacagcggaatgcgtccgtcaggtggcgctgggcatgaagaaaaagcccgttatcgtcaaggacgcacccagcttcgtgctgaaccgcttgcagcaggccattctgcgggagtccctccacatcgtgcagcagggcattgccagtcccgaggcggtggacgacgtgatgaagtacgcgctgggtttccggtacgcctgctttggccccttcgagacctgcgatctgggcgggctggacattcaccacaacatcgccaagtacaccttcgccgacctgtgcaacgccaccgagccgtttggtctcatcagcgagtgcattgagcacgaccggctgggcgtgaagaacggcgcggggttctatgactactccgacggcaaggacgtggaggtgatccgccaccgggatcacatgttcaataagctggcgcaatgcttgtttgaggacgaggagtaa

SEQ ID NO: 1983 - DNA, 966 bp, Unknown
  Description of Unknown: Firmicutes sequence
atgaaatacatcggcattgacattggcggcaccaacctgaaggcggggctggtggacgaaacaggacagctgctggctacccgcaaaatgaaggtggccggtatcgccgatccggcagcgctggcatggacgatccacgcgctgagcgtggatctgtgtaaggatttcggctgcgagctgacggatatcttttccatcggcgtgggctgtcccggcgcggtggagatccggggcggctccatcctgtatacctgcaacctgcccctgcggaacgtgccgcttcggcggctgttccaccagctcagcgacctgcccctgtacatagagaacgacgccaactgcgcggcactggcggagtactatgtaggcggcggccggggcagcaagcgctttatcaccgtcacgctgggcaccggcgtaggcggcggcatcatccataacggaaagatcttccacggctccaacggtatggcgggcgaggtgggccatatgtccatcgaaatggatggcgaggagtgcccctgcggacgccgcggctgctgggagcggtacgcttccgccaacgcactgaagcgccagaccgccaaggcgtggcaggagcaccccgacagcattctggcgcgggtcatcgccgaaaacgacaatcatgtgtccggccaatcggcctttatcgccgcccgtcagggctgtccggtggggcaggcggtctgcgaccggtatatccgctaccttactgccggaatcgtgaacatcatcaacatcttccagcctgacacgctggccattggcggcggcgtcagcaacgagtcggatgaacagctgctgcttcccctgcgccgtcaggtagcggctcatagtctgccctgcaactacgataaaatgacgaagatcgtcaaggcccagctgggcaacgacgccggtatcatcggcgcggcgctgctggggaagaacaagcggatcatctga

SEQ ID NO: 1984 - DNA, 1461 bp, Unknown
  Description of Unknown: Firmicutes sequence
atgccgcagttgctttgcgctggaaaaaccacttttattttgtacatgtctgtgttaaaatatgtaaccgtgaagagaaaatcgcttcacgggaggaacgatatgaaaattattattgtcggcaacggcaaagtgggatatgccatcgccaattcgctggcgcaggaggatcacgatatcatcatggtggacgccagcaccagcgccctgcggaaagcggaaagcaccatggacgtgctgtgcgtggagggcaacggcgccagcatcagtgtgctgattgaggccggcgtccgcgacgccgatctggtgatcgccgtcaccaatcaggacgagatcaatctggtctgctgcctgatcgccaaaaagctgggagcgggccataccatcgcccgtgtccgcaacaccgattaccgccgggacgaggagatgctgaaaaaggagatcggtctggatatggtcatcaatcccgaccttgcggcggcgcaggaaatcgcccggatactggccttccccgccgccttcagtgtggagccctttgcccggggccgcatcgacatgatcggcttccaggtaatggagagcgacaccatctgcggcattcccctgagtcaggcccaccgtctgcgccaggcggaggtgctgatctgcgcggcggagcatcagggcgaatacatcattcccgacggcagcttcaccccctcggcaggcgaccgggtgtacatgctgggcgccaagccggagctgcagcggatgctgaaggaaatgggccgcacgtggcagaaggtgaaaaaggtgtccgtgctgggcggcagccgcagcgccatgtatttggcgtgggagctgcagaagaccaacaccagcgtccgcatcgtggaaatggatccagacaagtgcctgcgcctgtcggcccagctgccccacgtgctggtgattcagggagacggcaccgacaacaccctcttacagcaggaggggattctggatacggacgcctttgtggccgtcaccaaccgggacgaagagaacctactgatggccatgcacgcccagcgcagcggcgtacccaaggtactggccaagatgacccgccccaactatatggagctggtcaacagcaccggcatcgactccattatctctcccaaggacattatctccagccagatcctgcggtatgtgcgggcactgggtaatgccgagggcagcaaggtggaaagcctttacaagatgctgggcggtcacgtggaggcgctgtccttcaccgccgcggcttccagccacgaggtgctgggcaggcccctgaaggatctgccgctgcggaaaggactgctggtggctgccatcgtgcgggatcttcacaccatcatccccagcggtatgaccaccattgaggacggcgaccacgtggtggtggtgacacgcgccacaggactggacgacctgacggacattctggcgtga

SEQ ID NO: 1985 - DNA, 1269 bp, Unknown
  Description of Unknown: Firmicutes sequence
atggcagttaacaccgatctctccctgcggcggcaggtgatctacagcgtgtttgttcgaggacacaccaaggagggcacgttccgtgcgctggagggcgatctcgaccgcctgaaagcgctgggtgcggatatcctgtggctgatgcccatccatcccattggtgaggagggccgcaagggcaccatgggcagcccctacgccatccgggattaccgggcggtgaaccccgacatgggcaccgtggacgacctgtgccatctggtggacgccatccacgaccggggcatgaagtgcatcatcgacgtagtgtataaccatacctcgccggactccgtgctggcggagacgcacccggagttctttttgcgggacgagcagggaagacccacccgcaaggtggccgactggtgggatattgtggatctggattacagcaaccgcgacctgtggcgctatcagatcgatacgctgaagcagtgggctgccatcgtggatggcttccgctgtgatgtagccagcgctgtgccggtggagttctggcggcaggcccgtgacgaggtggagaccgtccgtcccggctgtatctggctggcggagagcgttcacggcgctcatgttttggccatgcggaggatgggcgcttactgcgccacggataccgaggtgcagtccgtgttcgaccttacctatgattacgacgtttggcccttctatgagggcgtgctgaccggaaaggtgagtctgcgggagtacgcggatatcctgacctatcaggagctgacctatcccggcagctacgtcaaagcccggtatctggaaaatcacgacacaccccgtgccgccagctggatgagggacgatacccagctggacaactgggtggcgttcctctacttccagcggggcactgtgatgctctacagcggcatggaatacgcccccaaggaacgggtggacttctttgaaaatcagagcaactatggcgacatgcagcgggacatgcagctctatctgcgaaagctgaaggagctgaagcagacgctgcccatcaccggcggctattggctggaggagagaaacggcctgctgctgggacattacgagggcccggagggcaaggcgctgggcgtattcgacctgtgcggacagggcgcggccgatgtggcggtagagctgccggacggcgactatcccaaccgtctgggaggcagcgtgaccgtaaagaacgggcggcttgcttttgatggtaagcctgtggtgatttga

SEQ ID NO: 1986 - DNA, 822 bp, Unknown
  Description of Unknown: Firmicutes sequence
atgcgtcctgacggcaagcgggtcaaagaccttccgcccattgtggcggccattccctatatcatgcccaagcggtatgacgcccagaacaccattaccgagtatattgacgaggagctgatcaagtcctacatccgggaaaagcgccgtaccggcatccggatcaaccatatggccgtcatcatcgccgcctactaccgggccgtgatgtataaccccaagctgaactacttcatcatgaacagcaaggtatacaagcggaaccacttctgcgtgtccttcgtgatcctgaagaagctggcggacggacggcctgacgaaacatccctgaaaattttcctgacgccggaggacaccgtgttctccatccagcagaagatcaccgacgccgtgtccgccaacgccgccaccgagcagaagaacaataccgacaagttcgcccggatgatgttctccatcccgctgctgcccaagctcgtcatctggctggcctaccatctggataagctgggtctgctgccccggaagatcatcgacctcagccccttccataccagcatgttcatcaccaatctggcctccatcaagaccagctatatccaccaccattgctacgagttcggtaccaccagcgtgtttgtctgcatgggcaagcctgtgccggattacatgagcggcaatctcaacaagaagatcatgccgctgggtgtggtgatggacgagcggatctgcaccggctatgaatacgccgccttctgcaacgatttccgcaagttcctccgcaagccggaggaactggaggttccctatcaggcggaataa

SEQ ID NO: 1987 - DNA, 1212 bp, Unknown
  Description of Unknown: Firmicutes sequence
atggcggatcgggtaatcctgcattgcgatctgaactgctttttcgcgtcggtggagcttctgcgctatccggcgctgcgggacgttcccgtggcggtgtgcggcgacccggaatcccgccacggcatcgtactggccaaaaacgaggccgccaagcaactgggcgtgaaaacggcggagaccatctggcaggcccggcagaaggcgccccacctcattaccctgccgccccaccacggcctgtaccgggagtacagccaaaaggtcaacgccatctacggccagtgcactgatctggtggagcccttcggcatcgacgaaagctggctggacattaccggcagcatgcacctgttcggcggcgacggcaaagccatcgccgaccagctgcgccagcgtctgcgggaggagctggggctgaccatctccgtgggcgtcagcttcaacaagatcttcgccaagctgggcagtgactacaaaaagcccgacgccaccaccgtcatcgaccgggacaactggcagcgcatcgtctggccgctgccggtgggtgacctgctgggggtgggacgctccacccagaagctgctgcggcagtacggcgtggagaccatcggccagctggcggcatttccccgtgaaacgctggagaccctgatgggcaagcacggcgcacagctgcacgactacgccaacggacaggagaacagtcccgtccgtcctcagcacgaggcggagccggtgaaatccgtgggcaacggcaccaccttccccaccaacctgacccgctgggagcaggtgcgcgccggactgtcggcgcgggcggacagcgtggcgggccgtctgcggcggtacggcatgtactgcggcggcgtggcgctgaccatccggtacgcggacttccgccagttcacccgccagacccggctgagcggccccacccatctgcaaaaggatatctatcgggcggcgctgacgctggcccagcaggcgtggcacgcgccggagcccatccgcgccctgacggtgacggcgctgtacctgacgccggacggtgaaagctaccagcagctcgacctgctggcgggcgacacgacccgccgggacgagaagcaggagcggctggaacaggccatggacgccatccgcggcaagtacggcaagggctccatcaccttcggcaacacgggaaagttcagcggctgggacgattga

SEQ ID NO: 1988 - DNA, 1383 bp, Unknown
  Description of Unknown: Firmicutes sequence
atgagcaacagcagcgggactctggaaaaattcgcaggttcgttgagccagctgatccggagcgagtatcatatcggcgaagaatattaccggggcgacgtaaagcgcggtctgcgcaacaacgacggtaccggcgttctggcaggcgtgtccaaggtgggcagcgtgcagggctatttcattcaggacggccagcgcattcccaagcccggccagctgtactaccgcggtatcgagctgaacgagatcgtggaggctcaccgcaaggcgggcaccttcggctatgaggaggtggcatatctgctgctgttcggctatctgccctcccagtcagagttggccagcttcaacgagatcatgaaccgcgcccggaagctgccggacggctttaccgaggatatgatcatgcggcaccccagccggaacatcatgaacaagctggcccgcagtgtgctggcgctgtattcctatgacgacaacccggacgatacctccgtggagaatatgctgctgcaatccatcaagctggtgggctgcttcccctctatcgtggccaacgcctacgcggtgaagcggcactatttccagggagattccctgcacatccacttcccggtggacgatctgtccacggcggaaaactttctgcggatgatccgccccgacaagcagtacaccgaggaggaagcccatctgctggacatgatgctgatggtgcatgccgagcacggcggcggcaacaactccaccttcgtgtgccgcgccatgtcctccagcggtacggacacctacagcgccatcgccggagctgtgggctccctgaagggcccgctgcacggcggcgccaacgccaaggtgatggagatgttccagtacatcaaggaaaatgtggatccccacgacgacggctctatccgggattatctgaacaagctgctggacggcgaggccggtgacaagtccggaaagctctacggtctgggccacgcggtgtataccatttccgacccccgtgcggtgctgctgaagaagtacgcccagcacatggcggagatcaagggctacgccgacgagttcgctctgctgcaaaaggtggaggagctgggcattccgctggtgcaggagcgccgccacagcgacacccccatgtgcgccaatgtggacatgtattccggtctggtatacaccatgctgggcattccggaggatgtgttcacgccgctgttcgcctcggcccgtatcgcaggctggtgcgccaaccgcatggaggaggtcatcacctgccaccggatcatgcgtcccgcctaccgtgccgtgaccatcaaggggcattacgttcccatcgaggagcgtaccgccaagctggtgtcacccgaagcgtga

SEQ ID NO: 1989 - DNA, 1251 bp, Unknown
  Description of Unknown: Firmicutes sequence
atgggcacgattcccattgacggacactacccccatcaacaaacaaaggagaacgccatggacaaaaatgaaaaaaccgtggaaaccacggtgttcgactatctgcgctggcggggcgacctgaccttcgcccaggacagctttaacgaggtggacaatctggtgctgtgcatcatcgcctacctgaacttccgccgctttccggagctgaaaagccgcgaggcggacaaggccgtgccgctgggcgacgtggtcgcccgcatgacggcggaggacgagcagcaagggctgtcccccaacgactacatccccctgatgcgtctggcggcggagtcccagcggttcggcggcgtgcggatgctgggctatgaggcggtgcgggacgaggaaaaggagatgcagctggacgcggtgtccttcctgattccggacggcacgctgttctgcgcctttatgggcaccgaccggtcgctggtgggctggaaggagaacctgaacctcagcttcatggacgcggtgcctgcccagaccggcgcggtggcctacgtggaggacatggcgcggcactgccccgaccgtccgctgcggatcggtggccactccaagggcggcaatctggcggcctacgccgcgctgcacatcgacggcgcattgcagcgcacccgtctgctggacgcctataacaacgacggccccggcttccgcaaggacgtgaccgacacggaggagtaccgccgggtggcggcgaagctccacacctatatccccgcctcctccatcgtgggggtactgctggagcacaccgaggactacaccgtggtggccagcagcagccgtgccgtcatgcagcacgagccgctgacgtggacggtacagggacggcagttcgtccggtgtccggagcgctcggagctgggcaaggcctccgacgacgtgctgcgccagtggatcgcctccatgagccgacaggagcgggaggagttctccgaatccctgtacgacatgctgacccagggcggcaagctgcggtcgctggaggaggtcaggcagaaggacattctccggctgctggccgccgacgagaagaacaagggcatcgtgtcggaggtgctgcgccgtctggtgacggacgtgagggacgaggtgctgcgctcggcagaggccggtctgaagggcacggcggagacgctgaaggagaccgccggaaatctctatcaggcgggacagaaggcgctggagaagcggaagtaa

SEQ ID NO: 1990 - DNA, 1743 bp, Unknown
  Description of Unknown: Firmicutes sequence
gtgcgtgattttgacggtcgtgatctgccacgtgttctaaactggcatgaaatcttcgatttcattgccaagggagatgcggtcggctgcgcgcacccgttgggtgcactggcgaccgagaagaatttttctgacgcacatgtcgtcagaaaaatgattgaaatgattcgcgtctgcggacgcgaactctgcgaggcctttttggctgcggatatgaacgctgcgaggctatttgacaaagctgccgcttccggtcacggaagcggcagcttctttcttttgcttgcaaagccgggcgttgtgtggtattctgacggggaaaagaaaaccagaaggaggcatttatccatgagtgaaaagggtaagctgagcaaggcgctgctgtacgcgccggagaacggctttgaccgtctgccggagggcgaaaaggccgccatgcacgactattgcgagtcctataaggactttctgaaccacggcaagaccgagcggctgtgcgtggaatactgcattgagctggcgaagcagcacggctttgtggagtttcagccgggtatggcgctgaaaaccggcgacaaggtgtactgcaacaaccggggcaagggcatcatgctggcggtgatcggcaaagagccgctgagtgagggcgccaacatcgccgccgcccacaccgacgcgccccgccttgacctgaagccccgtcccctgtacgaggaggcggagatggcctatttcaagacccaccactacggcggcatccgcaagtatcagtgggtgacgatcccgctggagctgcacggcgtggtgacgctctcggacggcacggtgctgcccgtccacatcggcgacaagccggaggatcctcagttcatcatcaacgacctgctgccccatctgggccgcgagcagggcaagaagcccctgaacgaggccattcccagcgagagtctgaacatcctcgtgggctctcagccggtggaggacgaggacgagaagtcccggttcaagctggcggtcatgcagctgctgcacgagaagtacggcatggtggaggaggactttatctccgccgagctggaggctgttcccgccgggcaggcacgggatatcggctttgaccgcagcttcatcgccagctacggccacgacgaccgggtatgcgcctacgcggagctggcgggcctgttcgacgcggtggagccccagcgcaccgccgtgtgcatcttcgccgacaaggaggagatcggcagcgagggcgtgtccggcatgctgtccgccgcctttgacaagttcatgggcgagctgtgcgacacccagggcgtgctgctgcgggactgcttcgccaagtccttctgcgtcagcgccgacgtgaccgccgcctacgaccccaactttgccgaggtatacgacaagcggaattccgcgttcatcaactacggcgtgggcctgtgcaagtacaccggagcaggcggcaagtccggcgcgtccgacgccagcgccgaggtggtgggcaagctgcgccgcctgctgaatgaggaaaaggtgttctggcagatggcggagctgggcaagaccgacgccggcggcggcggcaccgtggccaagttcatggcccagcggaacatcgacaccatcgacgcgggcgtgccggtgctgagcatgcacgccccctatgagacggtggcgaagctggactgctacatgacctaccggtgcatgaaggcggtatttgagaaggcgtaa

SEQ ID NO: 1991 - DNA, 1104 bp, Unknown
  Description of Unknown: Firmicutes sequence
atgcggatcaatgaattatccctgtcgggctttcgcaactaccatcgccagagcctgaccttcgaccccgactgcaacgtgatctacggcgaaaacgcacagggcaagaccaaccttctggaagcggtggtctatctctcttgcggcaagtcgccccgcacccacgcggacagggagctgatcggcttcgacgcgcccggcgcggtgctggagggccgcatcctgtcacgtgaccgggactttgtgacccgtatcgagctgaaccggggcaaaaagcggaagatgaccgttaacggcgtggccgcaaaaaacgccgccgctctctctgacgtgctgcacacggtgtttttcgcgccggaggatctgtttctcatccgggacggcgcggcggcaaggcgaaagttcatggatctgtccctgtgccagctgcggccccggtacgccgaggcgctggcggagtacagccgcctgtacgagcacaagacccgtatcctccgggacagcgaggactttcccggcttgctggacaccctgccggagttcaaccaccggctcattcaggtgggcgcggtgctgatccgctaccgggcgtccttctgcgaaaagctgcggcagtacgccgcccaggctcacgccgaatgcagcggcggccgcgaggagctgtccttgcagtataagaccgtcaaaactgtcaccgatccgctggcggatgcttcggtgttggcgcagcagctggcggagcatcagcagagccactacgccgccgagatcgcgtcgcgcctgtgtctcagcggcccccacaaggacgatatcgaggtgtccgtcaacggccacagcgcccggcagttctgctcacaggggcaggtgcggacggcggcgctggccctgaagctggcggaacgggagatccacaaggaaaccttcggggaataccccgtcatgctgctggacgatgtgctctccgagcttgaccctctgcggcaggagtacgtcctcaaccgcatcgccggaggacaggtgttcatcacctgttgtgaaaacgaccgtctggacacgctgctgaacggcaaagtgtttcacgtgaaaaacggggaggtgctgtga

SEQ ID NO: 1992 - DNA, 1854 bp, Unknown
  Description of Unknown: Firmicutes sequence
atgctggaatcgatccacagcccctccgatgtgaagcggctgaacagtacccagacccgtcagctttgcgatgagcttcgcacctttctggtgcgcagcgtggcaaagaccggcggccatctggcatccaatctgggcgtggtggagctgactgtcgccatccaccgggtgtttgacacgtcccgcgaccggctggtgttcgacgtaggacaccagtgctatgtgcataaaattttaacgggccgccgggagcagatggataccctgcggcagtttggcgggctttccggcttccccaagccctatgagagcgttcacgacgcctttatggcaggacatgcttccaactctgtgtcggtggcgctgggcatggcgaaagcacgcaccatgcgccatgaaaactacgacgtgatcgccttgatcggtgacggtgcgctgggcggcggtctcagctttgaggggctgaataatgccggagcctccggcgagcccatgatcgtcattttgaatgacaacggcatgtccatcgctcccaatgtgggcgcggtcagccgccatttgtcccgtttgcggacgaagccgggctactatgaattcaagaagcgttaccgccagctgctggggaacggcccggtgggcggaaagctctatcacgtcagccatgacatcaagacggcgctgaaaaagacgcttctgccggacagctccatgtttgagagtatgggcttttcctacatgggtccggtggacggccacgatgtggaagcgctgacgcaatctctgcaatgggcgcgggagcagcgctgtcccgtgctgctgcatgtgcgcactgtaaaagggaagggctattctctcgccgaggagcgccccgccgactatcacggcgtatcgccctttgatccggtcaccggtaagccactgcgtactgcaaaaatggatttctcccacgtgttcggccaggagctgaccgcgctggcaggggaggacgggcgcgtatgcgccatcaccgccgccatgcaggagggcaccggactgacggagttcgcccggaaatatcccgaccgcctttttgacgtaggtattgccgagggacatgccgtgtccatggcgggcggcatggcgaagcagggacttgttccggtgtttgccgtatactccagctttttgcagcggggctacgaccagctgcttcaggatgtggcgctggatggcctgcatgtggtgctgggcgttgaccgggcgggtctcgtgggcgctgacggcgagacgcaccacggctgcttcgatgccctgtatctctctcaggtgccccacatgacggtgctgtgccccgccagctttgccgagctgcggcagatgctgcgacgggcggtgttggagctgaccggccctgttgctgtccgctatccccgcggcggcgagggtgcgtatcaggactgctgcggcaatgagacctttacgcaggtgcgtccgggagcggactgcaccatcctgacctacggcgtcctgatcaacgaagcgctggcggcggcggagctgctgcatgaagcgggggtcgagacccgggtggtgaagctgaacgccatcgcgccgctggacggcaacgcggtgctggcggcgctgggcagtgaaaagcgcctgctagtgctggaggactgcgtgggcagcggctgtgtaggccagcggctgacggccattctggctcagcgtggccggatgccggagcggcttattttgaagaacctgggggacaccatcccctgtcacggcaccgtgccgcagctgtatgctcagtgcgggctggatgcggcaagtgtggcggccgcgttgaaggaggcgtgccatgagcaataa

SEQ ID NO: 1993 - DNA, 1035 bp, Unknown
  Description of Unknown: Firmicutes sequence
atgaaaaaagagatcgcgcccaaggtaacgctgcgtgtcaaattttttctgatctgcatggcagaatttatcgccgtggtgctgctgtccgaattggcgggttggctcctgaagcgctggctgggcgttaccatggacattcccatcttcgtctgggcgatactgttcagcgttgtggtgggcggcgctgtcaccaactatatcacccattccttcatcgaccccatcacccgcctgggaaaggccatgaaggaggtagcgggcggaaattttcatgtggccatgcaaagcgacagcaagttgaaggaagtacgggatatttatgaaagcttcaatcggatggtcaaggagctgggaaacaccgagacgctgcaaacagatttcatttccagcgtgtcccacgaattcaagacgcccatcaacgccattgaggggtacgcctctctcctgcaggatcaccaccagtctccggaggagcaggagacatacattgaaaaaatcctgttcaacaccaggcggctgtccacgctgacgggcaacatcctgctgctgtccaagatcaacaaccagtctatccggccacagcgcacagtattccgtcttgacgagcagatacggcaggccattgtggcgctggaacagaaatggacggagaagaatatcgactttgacgtagaactggataaggtaatgtacagcggctatgaaagcctgctgctccatgtctggagcaacctcatcgacaacgccatcaaatttgatccgccgggcggcatgatctgccttcgtctacggcaaaccggcgatgaggcggtgttcaccattgatgacaacggccccggcgtagcgccagaggagcagaagcggatcttccataagttctaccagagcgacagctcccgcgaaatgagcggcaacggtctgggactggcgctggtcaagcagatcgtggaattcagcggcggaacagtttccgttgagaatctgccggaagcgggttgccgctttacggtgcggctccccatgcagccgtga

SEQ ID NO: 1994 - DNA, 855 bp, Unknown
  Description of Unknown: Firmicutes sequence
atggcaaccattaccaatcaggcggcactgtcctataacggcgtcaccaccctttccaatatcgcggtaggcgaattggtggaggtgctgaccgccaccaagaccgccgccgacaccacttacaccgcaggcggcgtcaagaccttcgtcatctcgctggtgaactccagcgcggcggcgctgacgggtctgaccgttaccgacacgctgggcagctatacgttcagcggcaacaccctgtaccccctgacctatgtgaccggctcgctgctgtactacgtgaacggtgcattgcaggccacccccaccgtcacggccaccgcgccgctgaccgtcaccggcgtcactgttccggcaggcggcagcgccatgctgatctacaccgccagagtcaacgaatacgctccgctgggggtggaggacagcatcaccaacaccgccaccatcaccggcggcgggctgacctcgtccgttaccgccacggagaccatcaacgcctcccccgcgccccagttggccatcagcaagagcatcagccccaccatggtggcggagaacggtacgctgacctatacgctgacgctgcagaaccggggcaacaccgccgccgacgcgggagatgaactggtcatcaccgacacgttcgaccccattctcaagaacctgacggtgcgcttcaatggtaccctgtggacgcaaggcgtccactacacctacgacgaaaccaccggtacgttcgccacggtggtgggcgcgctgacggtgcccgccgccacgtttacccaggatgccgccaccggtgtgttcacggtggatcccggcacctccgagctgaccatcaccgggtcgctgtaa

SEQ ID NO: 1995 - DNA, 1038 bp, Unknown
  Description of Unknown: Firmicutes sequence
atggaaacggcagtgaagctgacaaaattggcctcctgcgccggttgcggcgcgaaggtgggcgcgggaacgctggtgcatctgctggagggcttccgcacccacagcgatccccggctgctggtgggctttgacaagtcggacgacgccagcgtgtactatctggacgagaatacggcgctggtacagaccaccgacttctttccgcctatcgtggacgatccattcctgtacggccagatcgccgcgaccaacgccatcagcgacgtatacgccatgggcggtgagccgaagctggcgctgaacatcatgtgcatcccagaagccatgacggccgacatggtgcaggagctgctgcggggcggctacgacaaggcctatgaagcgggcgtcatcatcaccggcggacacaccatccacggcgcggagcccatctacggccttgcagtgtccggattcctgcatccggatcgcattctcaccaacagcggcgcaaagcccggcgacatactaatcctgacaaagccgctgggcgtgggcgtgctgactaccgccgccaaggcaggactggtgggcggtgacgtgatgggccgcatttatcgccagatggcaacgctgaacaaggccgcccgcgacattatggtgaaataccgcgttcacagctgcaccgacgtgacaggctttgccctgctgggccacagcttcgagatggcgcagggcagcggctgcaccgttcatatccagagccggaacgtccccttccatccggaagcctgggaatttgccgacatgggctttctccctgccggagcctaccgcaaccgggactatgccgaggcgggcgttaccgtccgcaataacgttagccgcaccatgcaggatctgctgtacgatccccagaccagcggcggcctgctgatggcggtggacgccgccgacgctgaaaagtgcctgcgtgagctgcaagacgccatcccccaagtggccgttgtgggctatgtgacggagcggcaggaaaactggattatcctggagtaa

SEQ ID NO: 1996 - DNA, 1272 bp, Unknown
  Description of Unknown: Firmicutes sequence
atgacactggacgaagccttacattacatccacgccgtctgctggaagggcagcatccccggtctggagcgtatcagcgccctgctggacaagatgggtcatccggagcggacgctgaaatttgttcacgtcaccggcaccaacggcaagggctccacctgcgccatggtggcctcggtgctgcggcaggcgggctatcgcaccggcctgtacacctcgccctacatcgtccgcttcaacgagcggatgcagatcaacggcgagcagatctccgacgacgagctgtgcgccatcaccgaggagatcaagccgctggccgacagcattttcgagcagcccaccgagtttgagatggtcacggccattgccttcgcgtggtttgcccgccgccggtgcgacatcgtggtgtgcgaggtaggcatgggcggcgagttcgacgccaccaacgtcatcggcgctcccgaggctgccgtgctgtgcaacatcggccttgaccacacggaggtgctgggcgacacactggagaagatcgccgccaccaagagcggcatcatcaagcccggctgcgacgcggtgctgtaccgctccaccgacggcgtggaagccgtggtggagcagcgctgccgcgaggtgggcgcagcgctccacaaggtggactttacccagctgcacctgcggcagcattcgctggaggggcaggtcttcgacttcggcggcaggaaaaatctccatctccccctgctgggcgagcatcagctccacaatgccgccgtggcgctgaccacgctggacgtgctgcaaaagcggggctggaacatcaccgaggaggatatccgtcaggggctgtcccgcgtcacgtggccgggccggttccagatcatccgccgcgacccgctgttcctcattgacggcggccacaatccccagtgtattcaggcgctggcccaaaatatcgcggattatttgccgaaccgtcccctgacggtgctgaccggtgtattgagcgacaaggattaccactgcatgtaccgcagtgtggcggatcacgcggtggagttcatcactgtcaccccggacaatccccgcgccctgacggcgcaggagctggcgaaatatctggccagcttcggcaagcccgtcaccccctgcgacacggtggcggacggcgtccgccttgccatcgaccacgcgggtaaggacggtaccgtgctgtgctacggctccctgtacctgctgggcgacgtgatcaactcagttgaagaaaccaaatga

SEQ ID NO: 1997 - DNA, 2289 bp, Unknown
  Description of Unknown: Firmicutes sequence
atgcggacattggcgatcctggcgttctccttcgcggtgggtacgctggcggcggcactggagccgaagggcggctggtggcttcctgccgcggcggtgctgctggcactggcggttgcggcgttcttcctgcgtaagcgtttgggagacaaaggccgccgtgcgctgatctgcgcgtcgctggcggcgtcgctgctgtatttcaccggctatcagcattgggtacagcagccggtgctggacaagtgcggacaggagctgcccttctccggcgtggtctgcggcgaagcgtgggaaacggactacggcgcgcgggtgacgatccggctggacggccatccctttgccaaagcggtgctgtacggcgatgaaacactgctgacgctggagccgggcgataccgtgtccggtacggcccggtggaacgacgccgcgcaggtggcggatacccggctgaccacctttacctccaagggtatttacgccctgctgtacgccagaggggagctggacgtgaccgccggttcctccaacagcctgcggtggctgccgcaacgggcgggacttgcctttcaggagaagattcgggccatctgggacgatccccggacagcgggcatcatctctgccgagctgaccggcagcaaatatgacattgccgacgaggattacctcgtcatgcggggtgcgggtctggcgcacctgttcgcggtgtcgggccttcactgcgcctttctggtgacgctgctggctctgctgctgccccggtcacggcggcggctgttctgcggtgttaccatctgcgtgctgctgttctatatgaatatggtggggttgtcgccctcggtggttcgtgcctgcatcatgcagatcgcactgctgctggcgcccctgttccgccgggacagcgactcctttaccagtctgggcatggcgctgctggtgattttgctgggcaatccctttgccgccgcgtccgtcagcttccagctgagctttgcggccaccttcggcattgtgatcctgtccggacggctgtaccgcctgtttttcgactggtatcaggggaagaataagcatgtgcggcgtgtgctggcctttgccggcgccaatctggcggtatcgctcagcgccaccatctgcaccgtaccgctggtggcctactatttcaatacgctgtcgctggtgtcgccgctggccaacctgctggcggtgcctgtggcggggtacggcttcatggcgtccttcgtcacggtgctggcgggcttcgtgtggcttccggcggccagagtgctgggttgggcggcctatggtctgatccatgcggtgctgtggatcgcgtgggtcttgacccgatggcggtatcacgccgtctattttgataaccactatctgcggctgtggatggtggggacatatctgagcttcagcctgtgcgccgcggtgaagaaatggcgcaagcggaagtatcttatcgccctgctggcaacggtgctgacgctggcgctggccatctggagcaacacgctggtctaccgtgcgggcaacatgaacgtggcggtgctggacgtgggacagggggagagcgtagccctccattccgagggacaggcccttctggtggactgcggcagctccaacagctatatcgacgcgggcgccgtggcggcggatcagctgtccgctatgggaatccaccggctgaaggcggtagccgtcacccatttccacgccgaccataccaacggtctgtatacgctgctgtcccggataccggtggataccctgtacctgccggatatagaggacgagtacggcgtccgggagcgtctgctggaagcggcggagcagtatgatattcaggtggagtgggtgcgccgcaccacgctggcggcagcgggcgacatggtggtgacgctgtacccgccggtaggcgagggtgacatgaacgagcagggtctgtccgtgctgggcagcgcccacgactttgacgtgctcatcaccggcgatatgaaggataccactgagcgggcgctgctcgaaaaatatcccatcccggatatcgaggtgctggtggtgggccatcacggctccaaatacagctcctgccgggagtttctggcggccacgcggccggagatcgccgtcatcagcgtgggccgcaacagctacggccatcccgcgccggaaacgctggagcgcttggaggaagcgggcgctctcgtgcgccgcaccgaccgggagggcaccatcaccattcatggaggagacgaacatggcggaacataa

SEQ ID NO: 1998 - DNA, 1353 bp, Unknown
  Description of Unknown: Firmicutes sequence
ctgccagatgaagctgaccatccggggcgcggagtgatgggcggcgtggttgtctgctttgccctgtttctggcggcgatggcggtctgccttgtcatggactggtcgttcctgtgggcgctgctgctgggtctggcgctgttcacgctccacggccgcaagcagggccacagcctgcaaaccatgtggggcatggcctggtcagagggccgcaaggtgctgatcgtactgcgaatctttgtgttcatcggagccatcaccgccatgtggcgcagcggcggcaccatcgtgtttttcatctactacggcgtacaggccatctctcccaagctgttcgtgctggtggcctttctgctgacggcgctgatcgcctacgcactgggcacgtccttcggcgttatcggcacggcgggtatcgtgctgatggctctggcccgctccggcggcgtcagcgaggcggtggcggcaggcgcgatcctgtccggcgcgtatttcggcgaccggtgctctcccgcgtcctcctctgccgcgctggtggcggcggagacggggacgaagctctatgacaacctgcggaacatgctgcgcaccggcgcgctgccggtggtgctgaccatcgccgtctacgctgtgctgtccgtccgccaccccatcacggcggtggacgagagcctgctgcaagccctgcgggacagcgctgtcatctccctgtgggcgctgctgccggcggcggtgatgctggtgctgccgctggtgaaggtgccggtgctcatcagcattgccctcagtgtggcggcggcgggactggtcagcgtgttcgtgcagggcatgacggtgtgggacatgctgaaaacggcggtggtaggctactatcccgccacgggacagctgaaggatatcctctccggcggcggtatcgtctccatggtgaagccggcggcgctggtgtttaccacggggctgctggcaggtctgctggacggtatcggcgtgctgaacggcgcggtgggactggtggaaaagctggcccggcgctggggccgctttgccgcttcggcggcggtgagtctgggcgcgggtatgatcttctgcaaccagtcggtggtgatcgtcatgggcaatcagctgctgcaccgctgctataccgaccccaatgagcaggcggtggacatggaaaacagcggcatcgtcctgtcggcgctgatcccgtggaacattgcgtgcagcatcccattggtgatgctgggggtggatcagcgggccattccttacgccgtgctgctgtacatgatcccgctgatctacggcctgacaaaacgatatgtgtatccccataaggagaaatgtgtatga

SEQ ID NO: 1999 - DNA, 1662 bp, Unknown
  Description of Unknown: Firmicutes sequence
atgaaacctaccaaacgactactcgccttgcttctggcgctgtgcatggcgctgacgcttgccgcctgcggcgaagcggagccggagcatatgaccgtccgcgccgcattggtggacgcgccccacacgctggatccggcgctggccgtcaccgaaacggaaaagaccgtggacgcccagctgtttgaaaatctgatgaagatcaacaccgccggtgcccttacccccgcgcaggccgccagctatacctataccgacaacatggacggcaccgagacgtataccttcaccctccgcaatgatatctactggtcggacggccagaaggtcacggcgggcgacttcgtttacgcctggcagcgtctggtggatccggagaccaactccccccacgcttccatcctgaacatggtggcgggctatgccgacgcggtgtccggcgatccggcggctctgcaggtctgggccagcgacgaccgcacccttgtggtggtcatcgagggtcactgctcctacttcctgccggtggtgtgcacggcggtgtccaccatgccggtgcgcgccagcgtcacccagacgccggagggggagggcgacaccgctgacacggccgatgataccgaaccgacgcagcggcccgactggtcgctgtcctccgccacgctgctgaccaacggcccctacgccgtctcgtccatgacggcggacggcctgaacgccagcgccgccaagaagtactatgacgcccggcgccttggccccgatcagctggagttcgtctatgccgccaattccgccgacgccatggcgctgtatgacagcggcgacgtggacttcgtgctggacgccggagagacggagggcgcggtggaggcttcctccgccgtggtcaagaccgtgctggtgaaccagatggccaccagcttgagcgagagcgtccgtcaggccatgtccatggtgattgaccgcaacgcactggcggagctggccggcggggaggacgaggtgttccgcgccgccgacggcctgatccccgacggtatcaccacctctcagggcgagtccttccgtcaggccaacggcccggccatcgacaacgatccggagaaatacgaccagcggtgccagcaggcgacggagctgctgcgcagcgccggttatacccccaccacgctggagcatatgaacacggtgacgttgctgtacgaaaataccgccgaaaacgccaaggtggctcaggcgctgcaaaccgtctggcgcgaaaagctgaacatccgcatcaccgtccgtgccgtggcgccggaggatatgatgaccaccctgaaaagcggtgagttctcgctggcgctgaccagcgtcaacggcgaccgcaacacggcgctgagctacctgaaccgcttcagcagcagccagctggagaattacggccagtattactccaacgcctacgatatgctgatccgcaccgctgccaactccagcagcgacgaggcgcgggacgcctatctggcggacgcggagaccatgctgctggacagcggctacgtgatgcccctgtataacgagacgtatacgtggctgctgcgggacaccttcaccggcctgcacaccgacggcatgggggtctattacttccagaatgtggtaaaaaccagctcgtaa

SEQ ID NO: 2000 - DNA, 1344 bp, Unknown
  Description of Unknown: Firmicutes sequence
atgcccacctatccggtcgttcccaccttcatcaccgttcatctgggcctgcccgacagcagcgcccccaatgtgaccgttccctttaccagctacatcaagaacgtggcctcccacgagctgtaccccacctggccggaggcggcgctgcgggccaatatcatggcccagatctcctttgccctgaaccgggtgtacacagagttttaccgcagccggggctatgacttcgatatcaccagcaccacccagcgggatcaggcctacgtgcccggcggcaatgtgtttgagaatatcagccagatcgtggacgatatcttcaacaactacatcgtgcggcaggggaatattgagccgctgttcgccgccttctgcgatggggtgcgtacccggtgcaacggcttgagccagtggggcagcgtggatctggcagaggcggggtacatcccctatgagatcttgcagtactactatggagacgatatcaacatcgtctttgacgccccggtggccgacaatatcccctcctaccccggccgaccgctggaacggggctcctacggccagagcgtccgcaccattcagcagcagttgaaccgcatccatgagaactaccccggcatccctgtcatctccccggtgtccaacgcctatgaccgcaataccgaggacgcggtgcgggagtttcagcgggtgttcaatctggataccgacggcatcgtgggtaaggccacatggtacaagatcaaggaggtctggacaggggtgaagcagctcagcgagctggccagcgagggcctgaccctgatggaggtacagcccacctttccggaggtgctgcggtatggcgacgagggggtggctgtcagcaccttgcagtactatctggcgtttctgggctacttcctgccggagcagcctccggtggctctgaccggcgtattcgacgacgatacccgtgacgcggtgtatactttccagagcaattacggtcttcccgtggatggtatcgtggggcgggatacctggaaccggctgctgaatgtctacgaccagctgctgcgtgatctgccccaggactatcagaactacatcgagcaggtgtaccccggtcgctttctggtgctgggggacgaggggcgggccgtccggcagttacaggaaaacatccgcaaaatcgccgcgcaggatccggccatccccacggtggaggtggacggcgtgttcggcccggccacccagcgagcggtgctggccctccagcggcagcagggcatcgaccagagcggcgcggtggggccggtgctgtggacccgcgtggcagagctggcgtcgggcttgtga

SEQ ID NO: 2001 - DNA, 846 bp, Unknown
  Description of Unknown: Firmicutes bacterium sequence
atgaatgaaatatatgataaagtaaaaaaatgctacaaacaagtgagagaaaaaacagatttcaaaccgcagatcgcaatgatcttaggatcaggacttggagattacgcagaaacgatcgagattaaggagattattgattatcacgagattgatggtttcccgatttcaacagtacagggacataaaggacgttttgtattaggatatgttgaaagtgttccagttatgatcatggaaggtcgtgttcattactatgaaggatattccatgagcgatgtagttcttccagtacgtttgatgaggatgatgggagcagaaattttatttttaaccaatgcatctggaggaattaataaagaatttcatgcaggagatttcatgttgatcacagatcagatagcaagttttgttccatctcctttaaatggagtcaatatagaagaatttggagaacgttttccagatatgagtcacatttatgatgaagatctacaggatatgatcaggcagagtgcagatcacctgatgatcgatctgaaagaaggcgtctatatccagcttgcaggaccgaattttgaatcaccagctgagatacagacgtgtaaagtgatcggtgcagatgcagtcggaatgagtacagcatgtgaagcgatcgcagcaaaccatatgaagatgaagatctgtggaatttcctgtatttcaaatccagcagcagggatcagtgagaatccgctaagtcatgagaatgtacaaaaaatggcagatgaagctgcaccgaaattcaaattgcttgtaacagaagcggtgaaaagaatggggaaatatttagaaacaacgaggtaa

SEQ ID NO: 2002 - DNA, 1701 bp, Unknown
  Description of Unknown: Firmicutes bacterium sequence
atggaacaagatgagaaatttgataaccagttcaatctggcactggatcttacgaaagaagaacgggaaaggtcagaagatttaaatgctggatatgatcagacatttgatcgatgggagattatctttcgttatgcaggtgatctaaagacattaaaaaaatcatcaacaaccaatattgaaccattgagcatgggatatgcgatcgcatatatgaaagaaaatgatttagaagcattttcaagaaatgaacaagtgatcttcatagaaaaaccaaaaaatttattattaaaccgacaggtatcaatttcagcttcctgtatgttgtcggtaaagaatacacctctttcattgactggaagaggtgtttttgttgcagtgatcgatacaggaatcgatatatttcatccggattttatcaatgaaaatggagatacgaaaatttatgagttatgggatcagacgatttcgggaatcccaccacagccatttataaatggaactttgtatacaagaaaagagatcaatgcagcaattcattcagaaaatggacggcaaatgtttcaaagtcgtgatgatcttggtcatggaacgcatgtagcatccatctgtgcaggaagaaatggtgtggcaccagaggcagaactgatcgttgtgaaattaggagatataagcaaacaaggatttccaaggacgacacagttgatgacagcactgcagtatgtgatcgatacagcgataagggaaaacagaccagtggcagtgaatatcagttatgggcataattacggggatcacagaggaaattcgttgttggagacatttgtttcacagatcgcagggcagtggaaaagctctatttgcataggaactgggaatgagggaaatagtgggcgtcataaacaaggaaagatcacgacaaaaacggagctgattttatttgatgtggcaccatttgagcagaacttgaatctacaggtctggaaagattttgtggatgaattcaagatcagacttgagtctccatcgggaatcacatatacgatcgtggaccagcaaggaaaatcgcaatacacatataaggatacaacggtttacgtgtacaatggatactcaacgccatataatgttaggcaggaactatattttagttttataccgatggaaggaaattatatagaaagcggtcagtggaagatagaaatttcaccagtgaatataaaaaatggtgaatatcagatgtggcttccggtatctgcaggaagcaatccagaaaccagatttttagaaccagataaagtatttactttaacaattccttcaactgcaagaaatgtgatttccgtaggtgcttatgatgtcagatatcaggcttatgcagatttttcaggaagaggagatcagaaattttgtgtagataagccggatcttgtagcaccaggtgttggaattttggcagcagcagttggaggaggcgagagtgtaagatcaggaacatcgatggcaacaccatttgttacaggatcagcagctcttttgatggaatggggaattgtaagagaaaacgatccatatctttatggagaacgaatgaaggggtatcttcataggggagcgagacgattacagggatatgatagatatccgaatgatgaaattggatatggacggttatgtgtgtctgaaagtttgtatcaataa

SEQ ID NO: 2003 - DNA, 1134 bp, Unknown
  Description of Unknown: Firmicutes bacterium sequence
atggaattaatttatcaggaagagaaagaagtaaaaccagtctatgacatgtatcagaagatttttgaagatcctgaagaatttgcaaagtattattttgaagaagtctatgcatccaatgaagtgcttctggcaagagaaggccagaagatcttaggaatgatacatttgaatccataccatataagaacaggggaaaagacatacacattaaattacattgtagctgtagcggtatggaaagaatacagaagacaaggaataatggcagcaatgcttacaaagtgcttaaatgacatgcatcagaagagacagccgtttacttatctgatgccggcgaataaagcatattatgagccatttcagtttacctttgtgatggactgggaagaaacgatgattcattcaatgaatgattcggacaagataattccagcaatacaacaagatgcaagaattgtcacagcaccagaagaagaatatgaccgaattactatatttttagaacaatttatgcagccatatcagatttatacaattcctgataagcaatatttaagaagactttcaaaagaaagccagagtggtgaagggaacctcatggtatattatgagggagaacaattgacaggtgtttttgcagagagttttgaagatgatgaagtgtatatccgatgggcatattcaacgcagccagagaatatgctcaatgagataaaatatcgatataagaataagaagatttatattacagaaggtaatttaaccaaaggagaaaaaataccaaagattatggcaaggatcacagatctcacagcgtggggagagatccttcatggaaagagtgattttacattcaggattttggtcaaagatccgtatatcaaggatcagaatggtgtataccaattccaatgcctgaatcataagatatccattcaatgtgtagattcatcaaaagaaaatgcatgcaaagaaggacgatcagatgcacaagaatgggaagatgaaatttcaattgacgagctgacacaggtgttttttgacaacaatgcaggacagatattaaaacaacatgagtatctgaaagatatcgtgccggctggcccaatctatatttcagaggaggtataa

SEQ ID NO: 2004 - DNA, 2190 bp, Unknown
  Description of Unknown: Firmicutes bacterium sequence
atgaaaaaaagacctatggttcttatatttaccggagtattatccggaatggccgttgtatggaatattttatccatggcaacggctttttatttacttgcaggactctgcattatggtgtgtatgttttgctttgataagggatatggatggatcatcgcaggaatgatcttaggaattatatttgctgcatctgctaaaatctcgatgaatcttgatttttcacaagtcagatataatgaaacacaggacatcataggaaaggtagttgaagtatcgcaaacaaaaaccggaaagcaggcattgcttcttaaaaatgatatgctggaaggaaaaattttgttatatacatcaaatgacgaagaaataagttcaggcgatgtcgtatcttttaggggtagccttaaagtctttgatggagcaaccaatccaggacagttttccaacaggcattattattttagcagaggtatttattatcatgcatattcaaaagacatacttattaaaaaatctacagagttatgcttagatcaaatgatcgcaagatgcagaaaatatttaaaacaacaacttagtatgcagtatgatgaaggaatttcaaatttcctgaatgcaatgatgcttggagataaaacaaagcttaatgatactgtaaaagatgattttaaagaaagcggtctgattcatttaatggcagtatctggacttcatatttcgctggcaggaagaagcatttatcggctgtttcgcagactttgtggcagctttatgatcagttcagttattggaacgatgtcagcggtattttattgtgctttaacgggattttcagtatcttctttaagagcattgatcatgcttttgatctattttttatcgcagattttaggagaacattacgatttattatcatcggcttcttttgctggtgtgatattgcttcttatacgtccatacaggatttatgatacagcgttcctttactcatttacagcggtttttgtgatcggatgttatcagaggatcaagccaaggcttaagggcaagtttcaaaaaataagagaatctttattgttttgtacagcgattcagattggaatgtttccaataataatttattttcaatatgaagcaccgcttctttcgtttttggcaaatgtgatagctgtaccattggcatcgacggcatttacggtggcgtttgttttgatctttcttccacatacaatttttcacgatatcatttcgtggatgatatatgtgatcttatggctttccaaacgatcatatggaatgcttacaatcgggcatgtaccatttttctgggtgattttgttttatagtctgcttttgttgtgtacttctaaaagaaataaacttcaatttaagatcaggattggtcttgtttatacaggaattgtgcttcttatatttataccaaagtttcgaaagaagacgatcacttttcttgatgttggacagggagactgttttattgctgataccaatgcaggactgatcatatcagatggaggaagcagtagtgaagatcaagttggaaaatataggattctcccatatataaaatatcttggatatcaaagggtcaaaattgcagttatcagccatatggatgtggatcattattctggaattcttgaacttcttaagatgggaaggattgaatatcttggacttcctgaaatacaaaaggatgcagcaatggaaaagatcatagaagcggcaagacaaaataatactaaagttttttatttatcgagaggaagaacaattaagacgaaagatgattatcttaaagttctccatccggtaaaaaacagtaagatggaaaagaatgcggcttcaattgtcatgcaagggaatgtgcttggatacaaattacttcttacaggggatgtagaaaaagaaggagaagaacagcttctgggagaaggacttagccacgcagaaatattaaaagtagcacatcatggttctaagaattccacgagcagcgaatttttgcaaaaggtattgccggaacaaacgatcatatcctgtggacaaaataacagatatggacatccgcataaggaaacaattcacaggttaaaaagctgccatacgaagatcaaaagaacagacacaaatggagctgtcatttttcgagagaaaagagatggttga

SEQ ID NO: 2005 - DNA, 993 bp, Unknown
  Description of Unknown: Firmicutes bacterium sequence
ataatgctgcagaagagctttataaacgtgttacaggacagatggaggaataattgtatgaaatatatctatggaattgatatcggtggaacaactataaagatgggactgtttgcagaagatggaacattaaaagaaaaatgggagatcaagacaagaacagaagataatggaaagaatattatttcagatatcgcaacagcagtgaatgatcatatgaaagagaatgatcttacacgtgaggatgtgatcgggattggagtcggagttccaggtgcagttttggaatttgcaagggtaaatgaatgtgtaaatcttggatggggaagtgttgatgtggcaggtgagttgtcaaaacttacaggatgccctgtcaaagcaacaaatgatgcaaacgcagcagcattaggagagatctggatgggtgcagcagcgaaatataacagtgcagttatgatcactcttggaactggagtcggtggtggaatcatcattgatggaaagattgttgacggaagtcgtggatatggaggagagatcggccatatgactgtggatccttttgatgatcgagtgtgcaattgtggaaaaacaggatgtttagagctttatgcttcagctacaggaatcgtatatgagacaaagaaagcactcaaaaaatacgagaaatcaactacactgaaagacattactgaagtaacatcaaaagacattttcgatgcagccaaagcaggagatgaatttgcagccacacaggtagacaatcttggtaagaaattagcacttgcagcaggaaatattgcattgatggtagatccagaagtatttgtgatcggaggaggagtatccaaagctggacagatccttttagatgcgatcaatgcacattataagacatatacatttggaaaagcacaggaaacaaaatttgttctggcaacacttggaaatgatgcaggaatctatggtgcagccagcctgatgctttcataa

SEQ ID NO: 2006 - DNA, 960 bp, Unknown
  Description of Unknown: Firmicutes bacterium sequence
ttgcaaaaggaggacaacattttgatagaagtaaaacatctgaccaaaaaatatggcacgcatctcgctgtggatgacttgtcatttacaattgaaaaaggacggatttacggttttcttgggccaaacggagctggtaaatccacgactatgaatattatgaccggatatatcggtgcaacaagcggagaggttatcatcaatgggcataacattcttgaaggacctgaaaaagccaaaaaatgcatcggatatcttccggaaattccaccattatatcttgatatgactgtttcggaatatctgcattttgtagcagaattaaagaaaattccgaaaactgaccgtgattctcaggtcttaaaagttatggaactgatcaaacttgttaatatgaaagaccgcttgatcaaaaatctttccaaaggttaccgccagagaacaggacttgctgccgcaattcttggtttccctgatattatcatcttagacgaaccaaccgttgggcttgatccaaaacagatcatcgaaatccgtgaactgattcgtacacttgccaaagatcatacagtgatcctaagttctcatattcttgcagaagtgcaggaaatctgtgacgatattttgatcatttccaaaggaaaattagttgcagaaggaagtcctgagcaattagaagatttaactcatggaaaagaatctgttgaacttaccattcaggcagatcaagtttctgtaaaacagatcctttctgatatttctggcattgatgatatcagctggctgaatatcaatgaaaacagttgtcatattcagatcaatacaagcaacgatacgcaggaattatgtgcggatctctctcttgcatttgcacaacagaaaatgcctgtgacacagatgtttgtaaataaggcaactctggaagatattttccttgaattaactggaggtgaaaaataa

SEQ ID NO: 2007 - DNA, 1302 bp, Unknown
  Description of Unknown: Firmicutes bacterium sequence
atgaattacacaactcagatgaatgcagcaaggcagggaattataacaaaagaaatggaagctgttgctacttatgaaggaattgatgtgaaagatcttatggctgaagttgcagctggcacgatcgttattcctgccaacaagaaccataagtgtttaaaaccttttggtatcggaaattccttaaagacaaagatcaatgtaaaccttggtacatccagagactgtttaaacttagatgttgagatggaaaaagtaaataaagctgttgagatgggtgctgaagcaatcatggatctttcttcttttggacatactcacgtatttcgtaaaaaacttgtcaatgaatgtcctgcgattcttggtacagttcctatctatgatgcgatcgtttattacaataaagcactcaaagacatcacatctcgtgaatggatcgacgttttcaagatgcatgccgaagatggcgttgattttatgacgatccactgtggaatcaatcgtaacactgcagatcgtttcaaagcgatgaagcgtaagatgaacattgtttcccgtggtggttccttaatcttcgcatggatggaagcaactggtaatgaaaacccattcttcgaatattacgacgaaatcctcgatatctgtaatgaatatgacgtaactttaagccttggtgatgcatgccgtcctggatgccttgctgatgcgagtgatatttcacagatcgaggaactggtaacacttggtgaattgactgcacgtgcatggaaaaaggatgttcaagttatgatcgaaggtcctggacatatgccaatggatcagattcaggcgaatatgaagattcagcagacgatctgtcatggagctccattttatgtactcggacctcttgttacagatatcgctcctggatatgaccatattacttctgcaatcggtggtgcgatcgccgctgcatctggagcaagctttttatgctatgtaactcctgcagaacatttacgtctgcctaatgttgacgatgtaaaagaaggtatcatggcttctaaaatcgcagctcatgcagcagatatcgccaaaggtgtaaaaggtgccatggactgggataaccagatggcagctgccagacagaaacttgactgggaaaaacagttcgaacttgctcttgaccctgaaaaggcaagaagatatcgtgcagaatctactcctgaaagagaggatacctgtacaatgtgcggaaagatgtgttccgtacgtaacatgaatgccgtccttgccggagaagatgtggacgtcatctaa

SEQ ID NO: 2008 - DNA, 1341 bp, Unknown
  Description of Unknown: Firmicutes bacterium sequence
atggatgaagcatttatcaagaaagtgcagccaaacagcccagaggcagaacagtctgtgatcggtgcaatgatcatggatagagacgcgatcgctgatgttattgatattgtaagtgcggatgatttctatcagaagcagaatggcattttatttgaagcgatgacagaattatatcgggaaggaaagccggtggatctggtaacgcttcagaataaattaaagaaaaaagatgtgccggaatctatgaaatctcttgaatttatcagagatcttctagaagcagtcccaacgtctgcgaatgcgaaacaatatgcaaagattgtcagtgaaaaggcaacacttcgtaaactgatcaaagtcacagaggacatcacaacggaatgttatctcggcaaagatgatgtgacagagattcttgaccatacagagaagaatgtgtttggacttcttcagcaggcaagtggaagagaagattttgtaccgattgataaagtcgtgttaaatacgctggacgcgatcgaggaggcagcaagctctgagggacgagtgacgggtattgcaacaggatttacagatctggattacaaattatctggattacatccatccgagcttatcatcgtggcagcacgtcctgctatgggtaagacagcattcgtattgaatattgcacagagagcggcagtcagagatcatgttccaaccgcgatctttagtctggagatgtcaaaggaacagcttgtaacccgtatgatggcgatggaagcgatggttgattctcagtccatccgtactggtgatcttcaggaaacggactgggagaagatcatggaaagtgccggaacgatcggacgttctccattgatcattgacgatacaccgggtattacaattgcggagttgcgatctaagtgtcgaagatacaaacagacacacggacttgatctgatcattattgactatctgcagctgatgtcaggaggaaaacgttccgaatcaagacagcaagagatttctgagatttccagatcgttaaaagcactggcaagagagatgaatgcgccagtgatcgcattatctcagttaagtcgaagagtagaagagcgaaaaccagccaaaccaatgttatctgaccttcgtgagtcaggatcgatcgagcaggatgccgacgttgtaatgtttatttaccgtgatgaatactataacgaagattctgagaagaaaggaatcgcagagatcatcgtggataaacagagaaatggttcaacgggtagtgtagagcttgtatggctaggacaatacactaaatttggaaataaagaaagagcaccacattaa

SEQ ID NO: 2009 - DNA, 2025 bp, Unknown
  Description of Unknown: Firmicutes bacterium sequence
ttgaataatcaacagaataataaaaatgataagaatgacaaagataacaagaagagaaatgccaagtatttagctgtttttcttgtagtttctattcttggaacaatctttttcaattccatcataacaaaatggagaaatggaaccgagacaacgatttcatacaataaatttgtcacaatggttgacaaggatcaagtaaagagtgtaaaagtaacagacactcagttaaaagtgacaccaaagaaagagggaaatcctttttacaaaacaacttacacagtacagagaatcagtggtgattatgaactggttaatcgtctgatcaagagtaagatcgcatttgagcaggaaccagaagatccgatggatacattcttatccgtagcgatcagtttgatccctactttactgatctttggattccttgttatgatgatgcgcagaagcagcggtatgatgggagttggaaagtccaatgcaaaagtatatgttgagaagaagacgggcgtgacatttgcagatgttgcaggtcagggcgaagcgaaggaaacactgacagagatggttgattttctccatcacccagaacggtatacagagattggtgcgaagcttccaaaaggtgcattgcttgtaggacctccgggaactggtaagacattgcttgccaaagctgtagctggtgaggcaggagtaccattcttttcactttccggatctgatttcgtagagatgttcgtcggagttggtgcatcaagagtccgtgatttatttaaacaggcacagcagatggcaccatgtatcattttcatcgacgagatcgatgcgatcggtaagagccgtgacaacggtatgcatggaggaggaaatgacgaacgtgaacagacactgaatgccttattagcagagatggatggttttgatacatccaaaggtatcattatccttgcagccacaaaccgtccagaagttttggataaagcccttcttcgtccaggacgttttgaccgtcgagttatcgtagaacgtccagacttaaagggaagaattgagacattaaaagtacatgccaaagacgttaagatggatgagactgttgactttgaagaaatcgcattagcaacaagtggagctgtaggatctgatcttgcaaatatgatcaacgaagcagccctaggagctgtcaaagccggaagaaaagctgtttcacagaaggatttatttgaggcggttgaagttgtcatcgctggtaaagagaagaaagacagaatccttggtgatgaagagaaacagatcgttgcataccatgaggttggacatgcattggttatggcattacagaaagaatcagagccagtacagaagatcaccatcgtgcctcgtacaatgggagcacttggatatacaatgcagcgtccagaagaagaaaaatatctgaataagaaagacgagatgttagcagatcttgtagcatttttcggtggacgtgctgcagaagaagtgaaattcaacacgatcacaactggagcttccaatgatatcgaacgtgcaacagcgatcgcgagagcaatggttacacagtacggtatgtcagaagaatttggtctgattggactggaatctatcacaaaccgatatcttgacggacgtgccgttatgaactgtgcagagacaacagcagccaaggttgacgaagttgtcatgaagatgttaaaagaagcttacgctaaagcagtcacatatattcgtgaaaatatggacattcttgacgaagcagcgcagtttttgatcaagcgtgagacgatcacaggaaaagaatttatggaaatcttcaataaatacaagaatccggaaaaagagtctgagaaaaatgtatcagagacaatggaaaaagatgtagaaactgaaaaaaatactcaggaaaatgttgaagtttctgagactaagacagacgaagtgaatacatcaacatttaacacaggatatgttcaatgggttgaagatgatgacgatgaagaataa

SEQ ID NO: 2010 - DNA, 1677 bp, Unknown
  Description of Unknown: Firmicutes bacterium sequence
atgccatgcgaaaatgccgcccaaagtgatgactactttgaatttattggagaatatagtggagttgttgactatgtaaaagaagaatttaacaccgaatgtatcacagtcatcgatcaaagatttgcaatcgcatacgtcccgaaaaatggacggacatcaatctacggacaaaactgcccatacaacacgatcccaagatgttttggcttgatggatacacagatgttagaagatgttggagttgcacaagtaaggagaagtacgttagaactttatggaaatggtgtcttggtcggaatgatcgatacaggaatcgactatgaacaccaggcattccgctatgaagacggtagcagcaagatttattctctatgggatcagacaatcaaaggcaatccagaagataccttcctaggatacggaacagaatacacaaaagaacagatcgaagaagcactaagaagtaaagtgccgcaagaaaaagtaccatcgaaggatgaatccggacatggtacttttttagcaggattaatcgcaggaaatgaggacaacgaagcaggtttttcagggattgccccaaatgcaggactcattgttgtcaagttaagaaaggcaaaagattatttaaaagaatactactgcattgacccaaaatacgaagtatatgcagaaacagatatcatgctggcagtccgctatattgatgcgatcgcagaacaactgcaaagacctgttgtcatatttttaggaatcggaacaagccttgcatcccatcttggaacaggtccattagatcaatatctgtcaggcagagctatgcttcgaggagtcgcagtcgtcacaagtgccggaaatgaagggcaggcaagacatcactacagcggtcaggtttcacaaaatgcatccaaagtagaagtaaaagtcggagaatcagaatatggatttacgatggaattatggggattagcaccaaaccgatattatgtggatatcgaatcaccatctggacagaaaacgggaaggattcaaggaggattaagcggacagagagatgtcacatttttactggaaagaacaaggctgatcgtggaatattttacagtagatacatctgcaggagcacctgtcatcgttatgagatttcaaaatccagcccccgggatttggaatatctatgtcagcgatgatgaagttggaaacagagagtttgatctatggcttccaattacaaattttctaagtgaagacacattttttttagaatcgacaccatataatacactggtagcaccatccaatacaggattattaatgtgttgcggaaattataattctaatacaggaagtcttgcgatcgacagcagcagaggtttcccaagaaatgcgatcaaaccagattttacagcacccggagtagagatcttaggaccacttccaagaaatcgttatggaagaagatcaggaaccagtgtctcaggagctatcgcagcaggaatcgcagcattgatgttggaatggggaattgtacagaaaaatgatatgcagatgaatacgacgaggattaagaattatctgatccgcggtgcaagaagagatcaagggagaatatatcctaatcgagaatggggatatggggaagttgatctttatgagacgtttttgggaatacggtaa

SEQ ID NO: 2011 - DNA, 945 bp, Unknown
  Description of Unknown: Firmicutes bacterium sequence
atgaaattagtgattattgaaccattaggtgtagaagaagataagttgatggaaatcgcacacaaagcattgccagattccgttgagatcatatcttaccagaccaaagtaactgacacagaaagcttaattgaacgaggaaaagatgcagacattatcatggttgcaaacctgccattaaatgcagacgtgattaaaggatgtaagaatcttaagatgcttgcagtagcatttacaggaatcgatcatattgcaatggatgcctgcaaagaacagggaattatggtgtgcaattgtgcaggatactcaaatgcagcagtctcagatcttgtttttggacttctgatctcattgtatcgcaatattatttcctgcaacgaggttgttagaaaagaaggaactaaagatggtctcgttggatttgaactagaaggaaagaaatttggagtggtaggaacaggagcaatcggaaccagggtagcaaatatcgcacaggcttttggctgcgaagtttatgcatattcaagaacagtcaaagaccttacaggagtgcagtatgtggatttagaagagcttttatctacttgtgatattatttcactgcatgtaccattaaacgcctcaacaaaaggtctgatcagcgagaaagagatcgcactcatgaagccaaatgcagttctcataaatacatcaagaggaccagttgttgacagtaaagcattagcagatgcattaaatgaaggaaagattgcaggagcagcagttgacgtttttgaaaatgaacctccagtagcaaaagatcatcctctcttacacgcaaagaatctgatcgcaacaccacatgtagcatttgcaacaaaagaagcattagtaaaacgtgcgatcattgattttgacaatgtaaaatactggatggaaggaaatccagtgaatgtaatgaactaa

SEQ ID NO: 2012 - DNA, 1947 bp, Unknown
  Description of Unknown: Firmicutes bacterium sequence
atgaatggtaaaaatatagtaaaaaatatagcaattggatttgcactagcgctcgctggggcgggggctgtattattttataagaataatatcgcaatgaatccaggagaaactttattaaaatatatgtcgtatgcagaagatggagaatatgataagatgtatgatcttctggataaagacagtcaaaaaggaatttcaaagaaagaatttataaaaaggaataaaaatatatatcagggtattggaatgaaaacacttgaagcagtggtaacgtccaagaagagagaaacaaccgttacttatcgtgtcaaaatgaggacaaatgcgggagttatatcttataataacaaaacaatctttgtaaaagaaagaagaagataccgtatggaatgggatgattctgtcatctttccacaacttggtgcggaagataaagtaagggtcaagacgctacatgcgaaacgaggaacgataaaagatgctagtgggaatgcacttgctatacagggaaagatctattcagtagggtttgtgccaaaaaaaatggattctgattctgtaaaacttgcttcgaagaaacttggaatttccaaagaagaaattcaaaaaaagctggaacaaaaatgggtaacaaaagattcttttgttccattggtaaaattaaaagaatattccagtgatctgttagatgtcaaaggaatcattatatcgacagagacaggaagaatctatccattaggtgaatccgcagcccatctggtaggatatctgcagaatggggaaggaaaagcaggacttgaaaagctttataataagcagctcagtggaacagatggtttagagatatatatagtagatgccaatggacagaaaaagcagttactggcagtgaaagctcagattgatggacaaagtttaaatacaacgatcgacagtaagcttcagaaatccatttatgaacaatataaaaaggataagagtgcacatgtagcaatgaatccgacaacgggagaagtgaaagcattggtaagcacgccttcttatgatgcgcaggcatttatccttggaatgacaccggagaaatggaataagatcaataatgatccaagacaccctatgcagaatcgtttcaaaggaatctttgccccagggtcatctttaaaaccgatcattgcagcgataggattaagccagaataaattcagtgcatccgatgactttggcaatagtggaaaacgctggcagaagaataaaagctggggtggatattatgtgacgactttgcacgactatagtgggcacaatgtaaggaatgcgttgatctattcagacaatatttattttgcgaaagcagcattaaagattggaaaagacactttaaaagaccagtttgataatcttttgtttggaaaaaacttggattttacattcggactaacagcatcatcttatggaagtgaaggatttacgtcagagatccagctggcagacagtggatatgggcagggagagatgatggtcaatccagtacatatggcaacgatctatacagcattttcaaataaaggaaatatgctaaatccatatctgatcaaacaaaaaggcagtaaaaagcaagtattaagagaacatgtattttcaaatgatgcagtaaaaacagtcaatgatgcaatgaaacaagtgatcagcaatccaaatggaacgggacatgctgcacagatcgatggtattgatctaaaaggtaagaccggaactgcagagatcaagcagtcgcagacagacacgaagggaacagaacttggatggtttgtaacgatcatgccaaagacagaatataaagaatccctggaactggtatccatgacagaagatgtaaaaaaacgaggcggaagtggatatgtggtcaataaaacaaagaagatcctagaagaatacctgcagtga

SEQ ID NO: 2013 - DNA, 969 bp, Unknown
  Description of Unknown: Firmicutes bacterium sequence
atggaacaaccaactatgattcaagatatttaccctcataaattagacaatcactacgatccagccaaaaaacctgatgctgacagtatcattttatatttcacaaagaatggccttcttcatcgtttattaaagaaatctgatctggaagaaatggggcaggagaatctctttttgcctgatgaaatgatccgtactggagatggcagaaaacttgcaaggcctactcttttaaatgaagaggatttatttttatcttttccccgcctaagtgattttgtaaatgatgctcatgttacagaagatactcttacttatcttttttctgttgacgatgatgattacttcttattaaataaagatcctgaagagattcctgaaggttataacttctgtacggtacgtgatctccgcaatcagcagatcggtccaaaataccgtacttttgctgcgatcacaggtctgcatctttataactggtaccgtaccaatcgtttctgtggctgctgtggtcatgaaactatccattcttctacagaacgtgccttaaaatgtccttcctgtggccatctgatctatccaagaatcgtacctgcagtcattgtcggggttaaaaatgatgataaacttcttcttaccaaataccgcaagggatttactccattcgccctgatcgccggatttacagagatcggggaaactctggaagagacagtctcacgtgaagttatggaagaagctggacttcgtgtaaaaaatattcagtattacaaatcccagccttggggtgttgttgatgatctgcttgctggattctactgtgaagttgatggtgataccgacattcatatggatgcttctgaattgaaacttgcagaatggaaaacacgagatgagatcgaattacaaccaaatgattttagtctgacaaatgagatgatgcgtgagtttaaggaaggaagaatttaa

SEQ ID NO: 2014 - DNA, 1080 bp, Unknown
  Description of Unknown: Firmicutes bacterium sequence
atgaaacgaatcgtattaaccggtggaggaactgccggacatgttacaccgaatatggcacttgtaccaaaactaatcgatgagggatataatatttattacattggatcttacgaaggtatggaaaagaaactgattgaagatatcggcattaaatatttcggaatttcttccggaaaattgcgtagatattttgacatcaaaaacttttctgatccattccgtgtgatcaaaggattttttgaagcgaaaaaaatcttaaagaaactccgtccagatgttgtattttctaagggtggatttgttactgtccctgttgtatttgctgcaaagcaacttcatattccggttatcattcatgagtctgatatgacaccaggattagctaacaaattaagtattcctagcgcaagcaaggtatgctgtaacttccctgagacagtcaaacttcttcctgaaggtaaagctgttttaacaggttccccaatccgtgaagaattatttacaggaaaacgtgaggaaggacttcgtctttgtggatttaacgaagataaaccagtacttcttgttatcggtggaagtcttggatctgttgcgatcaataatgcgatccgtaacaatattgatgcattacttgagaaatatcagatcattcatctttgcggacgtaacaaccttgatgaaagccttgaaggcagagaaggttacaaacagtttgaatatgtaaaagctgaattaaaacattattttgcatgtgctaacgttgttgtatcccgtgctggagccaatgcgatctgtgaacttcttgcacttcgcaagcctaatattttaattcctcttggattagaagccagccgtggagaccagatcctgaatgctgaatcttttgaaaagcagggttatagttatgtacttcaggagaaagatgttacgagtgagactttattaaatgctgttaacagcgtttatgaagaccgtgataaatatgtggaagcaatgaatacaagtgagcttgcaaatccaattgaaacgattgtgaatcttgccaatcagttagcttctcaaaaaagaaaacgataa

SEQ ID NO: 2015 - DNA, 1041 bp, Unknown
  Description of Unknown: Firmicutes bacterium sequence
atgaagaggaaacttaacaatgaagaattgatcacgttttgcagtcagatggcgttgatcttgaaatcaggaatatcttcgctggaaggaatttatatcatggaagatggagatgtctctggggatggaagagagattttaaaagagatacgagaagaaatcgagatgtgtgggatgttatatccagcaatgaagaagtcaggggtatttccggaatatgcattgcatatgacagagatcggagagcagacaggaagacttgatgagacgatggaagcactggcagcttattatcagagagaagaagaaatacttgaagcagtaaaaagcgcagtaacatatcctgttgcaatgcttggaatgatgcttgtgatcattattgtattatttgttaaagtaatgccagtgtttgaacaggtttatcttcagtttggacaggaaatgacaggtgtagcacgtaatattttaaatattggaaactggatgagacaatcagcgatcatactttctgtaattgcagtgatcgtattaatgatcgtgtgtagtgcagttttttcagaaaaattcaggaataaattatttgaaaaaatttcaaagatcggatttatgaaaaagctagcttggaaacgggcaagaacgagatttgcaagtggaatggcgatgtctttaaagagtgggcttgatatggatgaaagtcttacacttgcagaaaaactggtagattatgaaccgttaagaaaacagatcgcggtgtgcagagaagacatgaaaaatggagaatcatttccaaaagcactgaaggaatctcatatttttggaggaatgcaggaacgactaatggtgatcggatatgaaactggagcaactgatgaggtgatggaacagtctgcggatctgtatcagaaggagcttcaggatcagattcagaaaatgatcggcattctggaaccaacattggttgggattttatgtgtgatcgtaggagttattttgctgtctgttatgctgccattagcaggaatcatggcagggattggataa

SEQ ID NO: 2016 - DNA, 1269 bp, Unknown
  Description of Unknown: Firmicutes bacterium sequence
atgagaaaaacgcgaaaaacagcggctgtattggctctgtatgcggttttgatgcttagttcagcgtctgtagtaagtgcagatcaggtaaatgataagacatttgcaagagaacagacaaatgagcagactgacactagcaaagataattctgcccagacgacagaagcttcgacaactgaggcaacgacagaaaagaaaacagaagctaagccaacgacagaaaagaaagataagacaaatacaagtcataagaagaaagcaacaactaagaagacagagcgtaatacaataaagaaacataagaagaaaaagaaagataccaaagacaagaagaaagataaaaagaaagacaaaaaagataagaaagcgatcattccaaaagtctataatgaccatagcattgagatgaaaggaaagaaagaatctattcaaggatttatttattttaatcaggcagatgcagcatggaatgataatggttaccagattcatagcagcggatgcggaccaacagcaatggctgtctgcatcagttcattaactggtaaatgggttacaccagtagatacgacagtttgggcatataagcatggatattatacaagtgcgggtgcaagtcatgagatggtaccggcattggcaaagcagtataaactttcatgtaatgggctaggaacagatattaataaaatacgcagtgccttgaagaagaaacatccggtagtagcactgatgggacctggttattttacaaagaaaggacattttattgttcttgtagcgattgataacaatgatcaggtaacagtagctgatgttggaagcagagaacgtacacaatataaatatctattaaaagatgtagtagcccagacaaaagctgcttcagcaggaggaccttgctgggagatttactctaaagataagaaagcaaagaagacaaccgatacaaagactaagacaattcaggcgaagaaagaatttaaagatacatctaagatgtatgcagagatcaaagcagtcctacagaagaactatcatctgagtgtaccgcttaagaaaggaactttggtcaataaagatcagtttgtcacagttagctctttaacgatcaatgataaagttacagttatggatgtgtctaagaaacttacaacagatgttgatcttcagcaagtagtatctgagattaagacagatgcagtcaagggttctttttggaatacagtaacgattgaacctaataaaacaagtgtaacagaataa

SEQ ID NO: 2017 - DNA, 1353 bp, Unknown
  Description of Unknown: Firmicutes bacterium sequence
atgaatgaattacggccgatacagattatattgcttggcttttttattacaatatttgcaggttccattttgctgacattgccgattgcagctaaaagcgggcaggcaacctcatatatagatgcgttatttacagcgacaacttcggtatgtgtaacagggctggtcgttgaaaccacaatgacacattggagtctgtttgggcaggttgtgattcttttactagtccagatcggaggacttggagtagtaacgatcacaactgggatgttctatgtgctaggaagaaggatcacacttggaaacaggatgctgattcaggaatctttggggcttaatacattgacagggctagtgccattggttaagaaaatcattcttggaacagcgattgtagaaggggccggtgcagtgctttatgcaacacagtttataccggaattcggagttggttatggaatctgggcagcagtttttaattccatttccgcattttgtaatgcaggaatggatatcgtaaaagaggatagttttcgaagttatgtgacgaatccggttattaattttacaacaatggcattgatcgttcttggaggacttggatttattgtatggaaagatctttggcagagtatgaaaaagcttataaaagagaagattccagtaaaaagaattgtgcaacagttgaaatttcaaacaaagatcgtgttatcaatatcaacattccttattttatttggaacagtcttgatctttttgtttgaatatcataatccagcaacgatgggaaatctgtcattaccaggtaaagtcatggcatcactgtttcaggcagtgacgacacgtactgcggggtttgagacagttgcacagggagcactaacagatgcctcttctttagtttcgatgtttttgatgatcattggaggatcaccggctggaactgcgggaggtgttaagacagtgacctttgcgattcttatattctgtgtgatctcagcagctaagcaagaagagtcgatcagtctgtttaaacgaagagtgccaggtaatcttttgtcaaaagcactagcgatcattgtgatcaatttaatggtattaatgacttctgtgttattactcttagtatttgaccatggaaattttatggagtcttgttatgagtgtgtttcagcactcggaacggttgggcttacaaagggattaacaccgaatttgacaatcgcagggaaagtgattatcatcattaccatgtatcttggacgtgtaggaccgatctctatggcaatcggtttttcacagaagaataggaaaaagcaggtcatgtatccagaacaggatctgatcttatag

SEQ ID NO: 2018 - DNA, 966 bp, Unknown
  Description of Unknown: Firmicutes bacterium sequence
atgtattgcaagaagtgtggaaccaaaaataaagatgatgcaagattctgtgcaaactgtggagagaaactggtaataccgccacagcaacaggcaaaacagcagccagcacaacccaaacagcagatctacacagaacctcaaaatgaaccaaaacgatcatcaaaaagctggatcattgctttagcatgcgtgatcgttgtcgttgttggaatatttggattccaatatttaaaatcagaagacaaaaaagaagctacagcaacaaccgagaacaaaacatcagcaaaaacaacggaaaagaaagcaacagaaaataacgcaggagaagatgtagccgatgccaaggatagcacagagaaatcacaagtattatcctacacagacaacgaagacatggatttatccgcatgcacagacagcgatgattatcagtatgtaagcagcgaggacaactcatttgaattcgcctatccaaaatacctgtttaaccgcagttatgtaaataaaacaggaaatcaatacacattagaatacgcaaacagtgataaagtcgatgattacgagatcaaagcagttatttcatcacaaaaagcaggatcaggaaatgcagtaaaaagcgttcagaaattatacaaacaaaagaaaaaatccataaagaacgtcacatacgcatacccacaaggcggcaaaacaccaaaactatatcaaggtaaatcaagcatgatcgtcatgggatatttagacagcgacaaaacaaaatgtgaatatgtactgctcacaagcgatggaaaaaaagactacatgatgcagatcaatttctttgattcagattataaagatgaatataaagagatcaattatgtagtggattgtatgtatcgtggatgctcatttacgaattctacatatcagatgagaacatttgatcagtttagggaagacgatatgggagttaagaagtaa

SEQ ID NO: 2019 - DNA, 1401 bp, Unknown
  Description of Unknown: Firmicutes bacterium sequence
atgcagttctttatctttctatcaatctttttgctgacgacattgatatctgttttttttagtaagtttttgaatgatggatatcgagagaaaatatatgatcagaaagttgatagtgtagctagtcagtgtgcatggcttggagatcaggtagttggagttgattttcgtttagacgatggctccaactctctttctacccagacagataaattagcagcgagtatgaatggtcggatcatcgtaatcaaaagtaattataagatcataaaagatacacatacagattttcagtcaagattcttcctgaatcagaatattcttgatatcatggagggaaacaaagaaagaattgttacagagaatggaaaatatattgaagttttggttccaatcacatacaagacaggaaataaaacacagattcttggtgcagtaatagcgactgttccatcagaagatatgatgggtgcagtcatcgagatggaacacagaaggaatatgcttttggttgctttcattatatgcggattgtgtgcggcgatggcaatcagttatttactgacaagagatttaaagaagattcagaaagacgttgattttattgcatctgggcatgaggatgagtcgattgaagagacaggatttttggaaatgcgtatgattgtacagcgctttaacgagattcttggaagaatgcagacattagaagaatccagacaggaatttgtatcgaatgtgtctcatgaattaaaaacaccaatgacatcaatgaaagttcttgcagattctctgattcagcagggagatcaggttccagcagaactataccgtgaatttatgcaggatattgtcgcggagatcgatcgagagaatgttattatttctgacctgttatccttggtaaaactagataagaaagcagcacagcttcagatcactacagtcagcattaatgaattgttagagattgttatgaagagattaaagccgctggcacttcaacgtaatattgaattgatctttgaaagttttcgtccggttactgcggagattgatgaagtgaaattatcacttggactcacaaatctgatcgagaatggtattaaatacaacaaagatgacggatggatccgtgttacattgaatgctgatcataagtatttctatgtgaaagtagcggattcaggtgtaggtattccagaggactgtcaggatcaggtatttgatcgcttctatcgagtggataaagcaagatcaagagatactggaggtaccggacttggacttgcgatcacgaaaagcgttgtatctcttcataatggagagattaagctgtacagtaaagttggtgaaggaacaacatttaccttaagaattccgttaaaatataaaggctag

SEQ ID NO: 2020 - DNA, 1956 bp, Unknown
  Description of Unknown: Firmicutes bacterium sequence
gtgaatgatttagagagaatgaaagaactcatccagatcttaaatgaagcaggaaaggcttattaccagcaggataaagaagtcatgagcaaccttgaatatgacaagatgtacgatgaacttttagaactggagaaaaagacaaatactgtattatccaacagtccaacgatccatgtcggatatgaactgatgacatcattagagaaagaagcacatccatcaccaatgctttctctagacaaaacaaaagaaccagatcagctggcagcatggcttagtggacatgatggaatcttatcatggaaattagatggattaacgatcgtactgacttacgaacatggagaattagtcaaagcagtaacccgtggaaatggagaagtcggagaagttgtaacaaacaatgcaagagtatttgacaatgttccaagacacatttcttacgacggaacgttagtgatccgaggagaagcgatcattccatattcttatttctataagatgaatgaagagattgaagatgttgacagccagtacaagaatccaagaaatttatgcagtggttccgtcagacagttaaataatgagatcacagcaaagcgccatgtgcatttctatgcattcagcgtaagtgacatcgaaggaatggattttaataattcttttgaacagaaattagactgggcagcaagtcttggatttgacgtagttgaacatatcagagtaacagaagatacgattcgaggtgagattgaagaattttcaaagaagatcgaacattttgatctgccatctgatggattagtattagtttatgacgatcttgcatatggaaaaagtcttggaagaacagccaaattcccaagagattccattgcatttaaatgggcggatgaaacggcagatacaacattgacagagatcgaatggagtccatcaagaacagggcttatcaatccggtagcaatctttgaaccagtagaattagaaggaacaaccgtaagcagagcaagtcttcataatatcagtgtgatggaagaactggaattaggaattggtgatgagattgttgtatacaaagcaaacatgatcattcctcaggtcgcagagaataaaacgaaaagcggcaagattgagattccacatacatgcccagcatgcggaggagagacaaagattgaagatgaaaatggaatcagaactctgatctgtaccaacgaattttgcagtgccaagaagatcaagtcattttcacattttgtatccagagatgcaatgaatgtagatggactttctgaggcaacattgcagaagatgatcgatgttggactattaaatgaaatttatgatctctttacattaaaagaacataaagaagaaattttagaattagaaggatttggggagaaatcttttgagaatctgacaaaagcaatcgaagattccagaaagccggtattggcaaactttatttatagtttgggaattccaaatgtaggactatctaatgcgaaattgatctgcaagcattttaaagaagatttcaaagcaatcagagaagcaaaagaagaagattttacagcgatcgaccagattggaccgatgatcgcaaaggcaatggtatcatacttccatacacctcataatgaaaagattttagaagaacttttaaaatatgtgcagtttgaaaagaaagaagaagtagaaactgaacagatattagaaggaaagacatttgttgtcacaggttcacttaatcattttgataatagaaaacagttaaaagaagagattgagcagatgggaggcaaagtcacaggatctgtatccaagaaaacagattacctgatcaacaacgacaagatgtctcagtcttctaagaataaaaaagcaatggaattagatattccaatcctgagtgaagaggacttcttagagttaattggacgataa

SEQ ID NO: 2021 - DNA, 1407 bp, Unknown
  Description of Unknown: Firmicutes bacterium sequence
atggatattttaaagaaaatacgtccggaagaacaggattttcttgaggattttcaggagatggttgtttatcatataaaacagatgcaacagtgtttacttacagcaggaaaattgttttgtgaggaggaagaagaaaaaaaagaaacaaaaagatgtgggaggaatgtacttgaaagtgtgatcctcaaagagtgcgttggctgccgggagtatcagaattgtaaatttacaattgcagataaggacaaacttggaaatattatagaaaagcagggcggtttaagttatgcagatcttaaacaatgtcatccgtgcaagaatgggcaggattttattgaagaggctaatcagatttatgaaagagaactttttataagaggaatgagacatcatatggtacagatgcggaagatcattggaaatcaatatatgaaagccgggcaagttctaggtgatttttttgatgggaaaatgtcttatatacataaagatgatcagctatgtagtaagatcaaaaaagaatttgaaaagtataatttaaaaatatgggatgtttgtttttatgaaaatccgcaaaaaggaagacaaatttatctgtatctgaagaagaaaagaggaagtgaaatcagcacgaggcaggcagcagcattattaagcagaatattaaagaaaaaaatgatgccgcttccacaacagaaaaagcttgtaaaaaatggttatgaaatgtatggttttacgccagaagaaaaattttacgtgatcagtggcatacgtacagctgcttataaggatgaagagaagaatggtgattgtttttcaataggaaaaatcagagaaggaagatacgtggcaatgatctcggatggaatggggactggaaatgaggcaaataaagaaagcaagaaaatgatagaagtaatggaagatatgcttggcgcaggaatagaggaagaagtgtgtatacaacttttggattcaatcatagcatttgagacagaaaaagaaaaatatgcaacgctggatttttttcagcttgatctgtttgcaggaataggatctttttttaagattggagcatgtccatgtttgttaaaaagaaaagataaagtggagattttggtaggggaaagaactgttgtaggaatggatctgtttcaaagtaggattcctttttgccgcaaaaaaatggaaagtgaggatcttcttgtaatgtttagtgatggagtattagactgtatgccacaaaataacattgagacattagcatcgtttcttgaagaaatggatgtggtgcggccacaggcagtcgcagatcgattgtttgacaggattacgaatatggaagaatataaaaagaaagatgatatcacaatcttggtgcttggaatatgggataggtattga

SEQ ID NO: 2022 - DNA, 1359 bp, Unknown
  Description of Unknown: Firmicutes bacterium sequence
atggaaaatataacaattcaagacattttagacgcaactggcggaacacttttatgcggtgatccttccatgaagattgaccatttaagtacaaattctatggaggtaggtccaaacactttatttgtaccgatcatcggtgaacgcgttgacgcacacatctttattccaaatgcattaaaagaaggcggtgcttgtttaacacaggaacataatgaagccgaaggggatgccccttatattaaagtccctgatactttaacagcaatgcagcagattgcttcttattatcgaaataaaatgtcacttccaatcattggtgtaactggaagtgttggaaagacaacaacccgtgagatgatcgctcacgttttaaaaggaaaatataaagtattcgaaacaatcggtaatcaaaatagtcaggttggtgtgcctttaactttagatcatctgacatcagaagatgagattggtgttcttgagatgggaatgagtgaaaaaggccagatcacaactcttggcaacattattcatccaaacgttggtgttgtcacaaatgttggcgtttctcatattgaaatgatgggttccagagataatatctgtatcgaaaaattagatattcagaatggacttccagaagatggtgttcttttcttaaatggggacaatgacatgatccgcaaacatattgactatgtaaaaaaaccatatgaattttatggttttgcagatgattgtacatatcgtgcagaaaagatccgtgaaaagaatggacaaactttatttgaattccactacggtaatatgaaagaaaatatcacattaaatgttcttggaaaacataacgtatccaatgccctggctgcaattgcgatcggtcttcgctatgatgttccaatggatgcgatcaagacacaattatccacattttctggtcagagacagaatattgtccacgtaaatgactatactctgatcgacgatgcatataacgcaagtcctgattccatgaaagcaagcctgagcattttatctgattttaagacaagaggacgtaagatcgctgtcttatctgatatgctggaacttggaccagattcaccagaatatcataaagaagttggtcgttttatcgctacaacgaaagtaacagacctctttatcacaggtgaactttccaagaattatattgaagaagcatggaaagaaaatccttcccttcatacacgtgcattttcttccaacgacgagctgattgctttccttgaaacttacttaaaaaagaatgatgtcgtactgatcaaaggatctaatggtatgaatcttaaagaagtaagtaaagctttgatggcataa

SEQ ID NO: 2023 - DNA, 1344 bp, Unknown
  Description of Unknown: Firmicutes bacterium sequence
atgttatccatgaaaaacgaaattgagaaaatttgggatgatgtattagtcaagcttgagcaagagcatgacgtttccagtgctgcaattaatgcctggattaaaccattacatattaaagatgtccagtccaataagataattctttctctggatgctaaatatgatgagcggggtattcaatttattaagaaaaaaatgtacgatttttatatttcccttgctatttccgatcttaccggcaagaaatacgatatagaggttgagctagaaaaagatggagaaaaaccaaaacaaactcctgctgctacacctgaacatgacaataataacttaaatccccgttatacttttgatacattcgtaatcggtgacaataaccgcatggcacatgctgccagtattgctgttgcggaagctccagcggaagcctataatccgctgtttttatatggaggtgcaggtcttggaaagactcatttaatgcactccatcgcacattatatcattgaacataatagttctttgaatgttttatatgtaacaagtgaagattttacaaatgaagttatcaattcaattcagcacaaaaaacaggaagagttgcgcagtaaataccgtaatatcgatgttttattagtcgatgatattcagttcgttattggtaaagaaagtacacagcaggaatttttccatacctttaatgcactttataactctaaaaaacaaattattctttcctctgataaacctccaaaagagctggatgtattagaagaaagactccggagccgtttcagctggggacttccagttgatatccaacctccaaactatgaaacaaaggttgcaatcctcagaaaacgtgcagaattagacaatatttatattgatgatgaaatttttgattacattgcaacacacattaagtctaatattcgtgacctcgaaggtgcattaaacaaaattaaggtttattccaaattaaataaaaaaccaattgaccttgaattatccaaaattgctcttcaagatctgatcgataataaaacaaaacaggctattacacctgaattgatcatgcagacagttgctgaacattttaatattcagacaagtgatatcatctcaaaaaaacgcagtcatgatattgcttatccacggcagatctgtatgtatttgtgtaagaaaatgacagatcaatcactcgttaaaattggtgagatcattggtaagagggatcactctactgtgattcatggtattgagaaaattgaaaaagatcttgaaaaagaccctgaattaagcaaggttattgaagttatcaccaaaaagatggattaa

SEQ ID NO: 2024 - DNA, 1776 bp, Unknown
  Description of Unknown: Firmicutes bacterium sequence
ttgatttacggagaagaaatcatagaagaggtgcgaagccggaatgatattgtagatctcatctccacgtacgtaccgctaaagaaaaaaggaagttcttatttcggattgtgcccatttcacaatgaaaaatcgccctctttttctgtgagccgggataaacagatgtattactgttttggctgtggtgccggtggtaatgtttttacttttttaatggaatatgagaacttttcttttccggaagcgttaaaatatctggcagaacgagctggaatggagcttccagaagaagaattgaatgaagaagctaaacgaacaatggatgcgaaagccagacttcgagagatgaacaaactttctgccaattatttctattatctgcttcacagcaaacgagggcagaaaggacttgcgtatttgaaaaatcgtgggatcacagatgagacgatcaagagatttggacttggatatgcagatatttacaatgatgatctgtatcgttttctaaaaagcaaaggatacagtgatgaagaattgaaagattctgcactcgtaacgatcgatgagcgacgaggcggaagtgataagttctggaacagagttatgtttccaatcatggatgtcaataatcgtgtgattggttttggaggcagagttatgggagatggttcgcccaaatatttaaattcaaaagaaaccacattatttgataaaagtcgtaatctttatggattgaattttgcaagaagctcaaggaagaaagagattattttatgtgaaggatacatggatgttatatctatgcatcaggcgggatttacaaatgcagtagctgcgcttggaactgcatttactagtggacatggaacgttacttaagcgttatacagagaatgtcatactttcttttgacagcgatgaagcaggacaaagagctattttgcgtgcaattccgattcttaaggaagctggactgacagttcgtgtattaaatctcaaaccatacaaagatccagatgaattcatcaaagggttaggaagagaagctttggaagaaagaatcagtcatgcaacaagcagttttatgtttcagatacaggtagctgcaggaagatatgatcagaacgatccagaggagaagacaaaatttcagcatgaagcagcaaaattactttcaacaattgaagaacgtctggaacgtaagaattatattgatgctgtatcaagggaatattatattgatgcaaaagatttggaagaacttgttaattattatggaacttccagttatgcaacagcacagagacagcaaaatacgccaagacagtcagagagaaggctgcagcagagtgaagcaaaagaggaaaagaggaaacagccgcagaaacttcttcttacatggatggtaaatgaaccacagttatttgaaaaactggatgggatcatcggtccagatgatttttatgaacagatatatcatggagcggcattactgctttttaaacaatatgcagaagaaggggcagtaataccaggaaagatattaaatcaatatacagatctagaagatcagaaaaagatcgcagaattatttaatacaacactaaagatcagtccatcaccggaagatcgtgataaagcgttgaatgatattgtgcgaagagtaaaagaagacagcattgaacaacagatgaacgcaacaaatgatattttgaaatggcaggatttgatcagggagaaagcaaaccttgcaaaattgcatatttcattatag

SEQ ID NO: 2025 - DNA, 2538 bp, Unknown
  Description of Unknown: Firmicutes bacterium sequence
atgaaatacaccaaacaaaatattgagaagcagagaaaagttctttcttctgataaagtacggaagaattccagtgtttctctctttctttttaaatatgtttttattgtttccattatcctgatcgttgccggtcttggccttggtgtgggatttgttcgtggtatccttaagacaactccacagatcaccaaaaattccgtacattccaagggctatatcacaacgatctatgataataaaggtcagacaatcaaaactttatcaaaccatgattctaacagaatttatactcctctgtcatccatccccaaagatctccagcatgcatttattgccattgaggatgaacggttttacagccataatggtattgatttgtacgggatcattcgagctaccttccttggtattcgtaaccaatcattaagccaagggggaagtacaatcacacagcagttgatcaagaataatctgttaggaatccaacctgaaaaaactatgatggaacgtctggaacgtaagatcaaagaacagtctcttgcactagaacttgagaaaattgcttccaagaaatatatattggaagaatatttgaatgcgatcaatcttggagaaggaactcttggtgttcagacagcatctcagaaatattttaacaaagatgtctctgatctgacactttcagaatgtgcggttctggcaggaatcacaaaaaatcctacacgtttagatccaattactcatccggaaagcaacgcttccagaagattacttgttttacaaaatatgttagatcaacattatatcacaaaatctcaatatagagaagcacttcgtgatgatgtatacacaagaattcaaaaaaatgctgctgcatctacaacaaagaaaaacacgaattcttattttgaagatgcactgatccttcaagttgtaaaagacttaaaaagcaaactcgggtatgatgagacaaaagcttacagtgcaatctacagtggcggattaaaaatatattctacacaagatactgcaattcaaaatatcgcggacagtatcactagcaacccagcaaactatcctaaagccacaaaagtagctttaacctgctctttcacggtgcgtgcagcttccggagagacaaatacttacaccgaacataatctgcttcattacatgaagacccataaactaggaaacagcctggttttccagaatgcttccgatgcaaaagaaactctcgctaaatataaacattatataaaagataaaggtgcaatgatcatcgatgagacttcacagccaacgatccaaccacaaatttctttaacgatcatgaatcagtcaaatggttctgtagaagctttagttggaggacgcgatctgaagacttcagatctttcactaaaccgtgctactacttcaaccagacagcctggatcaacatttaagattttgtctgcatttttaccagcccttgataaaaatcatatgacacttggaacagtttatgatgacgctccatacaactataacgattccaatcgtccggtgcataattattacaaaggttacaaaggttattcaacgatccgtgaagcgatcacccaatcaatgaatattgtcgcagcaaaaactatttctgatgtaacaccaaagacatcttttgattaccttacaaaacttggtttttcaacacttgtttccaatgagtttacatctaacggtaacgtatatacggatatcacacagtcattagcccttggcggtctgacatatggtgtcacgaatatggaattaactgctgcctatgcttctattgccaatggcggtatgtataataaacctgttttatatacaaaggttgtcgatcaaaatggaaatgtcctgctttctaacaaaccaacgaagaaacggattatgaaatcaagcaccgcttttctgcttaccgatgccatgaaggatgtcattgccaaaggaactggtaaagacgcaaaactgtcttctcctatggctgttgcaggaaaaactggtacaacctctaacaattacgattactggttcagcggttatacaccttaccacacagcttctatatggatgggatacgacaacaatacaaatttcaattccgaaaacacacataagaaactatgggcaaagattatgaatcagatcatacagacaaaatccgagaaaactaagaatttctcaaaaccatcaaatattgtcaaggcaaagatttgtaaagagtctggaaaacttgccatcaaaggagtctgcgaccacgaccctcgcggtaattgtatcatcactgaatattttgaaaaaggcactgttccaaaacaaacttgtgatactcatgtagctgttgaaatctgcaagaaaacagataaacttgccaataaaaaatgtcctaaatccgaacgtatcaagaaagtttatatcgtccgaaaaaatggaagtcacggaaaaacagcagatacaaaattcctgcttccaaaaaaatatcaatctaattcctgcacaatgcattaa

SEQ ID NO: 2026 - DNA, 1077 bp, Dialister sp.
atgggaaagcatatcgtagtcattccgggtgacggcatcggcagggaagtcaccgatgccgccgtagaaattttaaagaaaaccgatgaaatttaccatctggatttcacctatgagtggaaggatgccggcggcacggcctatgataaatatggtgtgcctctgcctgaggatacgatagaggcctgccggaagggggatgccatcctcttcggtgccgtaggcggcgaccagtgggaccatctggaaccggcgctccggccggaaaaggccatcctgggacttcgcaaatccctgggtctttatgtgaacctccgccctgtaaagattgcggattccatgattgaatactctccgctgaaaccggaaatcgccagaggtacggacattatgatcgttagggaactggtgggcggcatttatttcggaaagcgatgcgaatcggaaatcgcaggcggcgtcgaaaaggcctgggatgtggaatgctattccgtgccggaggtggaaaggattacccgctttgccatggaagcggcgggaaagcggcatggacatgtgaccagcgtggacaaatccaatgtgctggcctcctcccgtttgtggagaagaaccgttacctctgtccgtgacaaagagtatccccatgtccatctggatcatatgtatgtggataactgcgcccagcagtttgccatccacccttccttcttcgacgtggtggtgacaagcaacatgttcggcgacatcctgtccgacgaagcggcagtcctctccggctccgtgggcatgctgccctctgcctccatcggcgaagaaacaagcctttacgaacctatccacggctcggcgccggacattgcaggaaaaggcatagccaaccccattgccaccatcctttccgcagccatgatgctccgctactccttcagtgaagacagagccgccgatgccattgaaaaagcggtgaacgatactctggaagatggataccgtaccggagatatttataaagatggcatgaagaaagtgaatggagaggggatgaccgaagtcattctggaccatctggatcaatga

SEQ ID NO: 2027 - DNA, 1005 bp, Dialister sp.
atggaagaaaagagaaatgaaacagggaagagtaagggcctgcgggtttttatcattgtcctgtttgctgtatttactgcctttgccatgattttcagcctgattttcggttcggcggacatttccttcggcacgatcctgcatacccttttgggaaatgtggaaactaccgatgaaatggtcatctggaatatccggttcccccggaatattgtaggcgccctggtaggggcgaacctggccgtatccggtgccattctgcaggccgtcatgaagaaccccctggcggacccgggcattgtaggtgtttccagcggcgccggcctggccggggtgattatgctgattttcatgccggaagcttctctcctcctgacgccggtggcctttgtgggagccatgctttccgccgctgcagtctatgcgctggcatggaaaaacggtatccgccccagccgtattattctggccggtgtggcagtgagcgcatttctgggaagcggtatttccgcccttcttgttttctattccgataaagtgcagggtgccctcctgtggatggtgggcggcctgtctgccagaagctggccccaggtggaagcacttttcccctatacagtgctgggccttgtgcttgccctggcaggctgcaaggcactgactatcctcagccttggcgatgagacagccagaggccttggggtgccggtggaaaaagtccgtttctccatgactgccgtggcagccctcctggctgccggtgctgtcagtattgccggactcatcggttttgtaggccttgtggtgccccatattgtaagactgattataggtacggactacaagtatgtagtgcccggttccgccatactgggagcgggagtgcttgtattctgcgataccctgggccgggtgcttttctcgcccattgaaatcccggcggggattattatggcctttctgggcgcgcctttcttcctgtatctgttaaggaggagcgcatga

SEQ ID NO: 2028 - DNA, 882 bp, Dialister sp.
atgacagcagacagaaagaaaggcatcctctccgcctccctgggttccatcttctggggcagcagcggcattgcaggccagtttcttctcatcaataagaatatagcccctgagtggctcacctttttccggctccttaccgccggatttcttttgctccttttctcccgtttcctgcatggaaatatcggcgccatctggaaggacaaaaaggacaggaacaccctcctcatcttcagtatcttcggcatgctgggcacccagtacggctatttcgcctccatcagcgccagcaacgcccctaccgccaccattctggaatacctcatgcccatcctcatcatcttctggtactgcctgaccgaaagacggtggccccgaaggcgggaaattttctgcaccatctttgccgtagccggcaccgccctcattgccaccggcggcagcttccggagcctggccatttccgaaaaagccctcttctggggcctcctctccgccctggcctgcgccctctacaccgtggcgccggtaaaaatcatcaggaaatacggcgcgcctctggtggtgggctggggtatgttcctggcctccttcttcctcatccccgtggcagccttcacccccttcaccggtgcggtggatatgccggtgctcctttccttcgcctatgtggttctcttcggcaccatctgctccttcgtcctctatctgggaagcgtggcctacatcctccccaccgaagccagcattatctccgccatcgagcctttctcctccatcctcttcgccttcctcatcttccacctcctcatgaacccctggcagcttctcggcatggccctcatcatcctggccgtaggcgccgtggcagggaaataa

SEQ ID NO: 2029 - DNA, 873 bp, Dialister sp.
atgtttctggaacaggagaaggaaaagtttatcgcctggtggcaggatatttccatgagggagctggccatatatctggccggcgctttctgcctgcttctcatcgtttctgtctattatgatattttgggaattacggagcttttccagtggtaccggttcgggcggaatatgggggagtgtttccttctgattttcctgacggagctcatgacagggaagagtcttctccatcctttctggcgcatcgggtatattcccttcttttcatggattttcattttcccctatgtgctcacccatgcggcgaacggcatgaaggatccttcctttaatcatctgagtccctatttcctcaccgccatcggcacgctccttctgattttctttatgatgaatgtgatctgccgggtgtatgtgggccggaagctggccacgctgatctgcctttcggcggtttgtttcttttcctgcagcgctttcatgttcctcattcattatgagttcatgcatattatgatgtcgccgaaggaaatgttttttgccatcaaccagccggtgcgctggttttaccgcattgttctgcctcatgtggggctcatgaatctccttctcatgggggcgggacttgtggcttttgtggtgctgtactggcagtggatttacgacagtgcctatgccctctctccccgctggataaagaaaatgaagaaatcctattcctgtatccaccgtcttctccagtttctggtcttcttcggctgcgcctggctcctcatccgccggctcagtgagtgcttccctctccacgattatgaaatggcgaagcagtataaggaatatatcgattttatccagaataccagactgtaa

SEQ ID NO: 2030 - DNA, 609 bp, Dialister sp.
atgaagaaacaaaaggggcaggatatcatcgaatacgcactgatgctggctgttgtagtgggcatcggcttcggcctctatacccacgtgggcataggagatcatatctctgctgtttttaacaatgccggtaatctcctggaagaagtggggaaggggaaacagaccacttttatttctcccgatgatgctattaagcggctgtttgatgagcggtacgggggctcgtcggatattctggagaaaccggctacgggagaggtaaaagatattgctttcgacagtaaagaaggacaggagctggccagaaagctcaatatacagaccaaagaaggagacggctggtatgtgaggatattctctcccggcacaacagtagttacctattattcggccagtgataacggcggcgtgaccttcagccagttaaagaatgctaaacctggcgataaagaatatctgacgaaaatatatattcatgaaggaatccacgacgggtcggggaaagaaacttataatactgctaatacagatagacagtctgatgtcggccatgtagagagggattccaagggtcagtttgtgagcatttatcccggatccaaatga

SEQ ID NO: 2031 - DNA, 345 bp, Dialister sp.
atggacgccaccctcgacagcgaagatattgcccttttgaaccggctctctgacaaacagaaagactacgccctcaccctctacaccgccagggaaaagaaaaaatccaccgcctacatcctgtggatcctcttcggcgtgtactacttctacctaggccatcccttcaagaacatactcctgtggctcctctgcttctgcgtcatcggagaaatctggtggattgtggaccttttccgcatgtccggcatggtgaagcggaaaaataaggaaatcctgatggagtgtatcaaagaagcggcgcagctctaccccgccccgccatcctcggatacctatgcataa

SEQ ID NO: 2032 - DNA, 276 bp, Dialister sp.
atgatgggagaagcggggaatggagaatggggattggggattggggaagtgcctgctgtcggttctccgctctccgagagtggccgcgcagcggacaatttccgccgaccggtatttacttacgagtggctcactttcggctttccttttgccacccgaccgatacaggatgacaagtggaaggcggaaaggaaagcacgtaaagcccctgcgtcttcttggggggcaagcgaacgtggtttgcaggggagcgtcagcgacctgaaaaccacgtga

SEQ ID NO: 2033 - DNA, 201 bp, Dialister sp.
atgttcgggaaaagggaaaggtggcggaaaagggagccgcagagcgtctccgggttcaaaaggttcaaagggtggttgcgccctgtacaggcgcaaattttaaagaaggggcgcggctccgccgcaggttgtgcagaaaagctgcataacctgccgcccatgacccattcggcagaaaaactactcagcggcaagcggtaa

SEQ ID NO: 2034 - DNA, 195 bp, Dialister sp.
gtgtcatttttatttctccataaaataaaggctgtgaaaaaaatggttatcatttcttcacagcctcttttcatcatatatttaatagatttaccgggaaccgtaaacagagccggacagttcaccgaaggaaagggggcgcccttccatggcggcaatccgttttttccgttcctcttcatcatattcccgaag

SEQ ID NO: 2035 - DNA, 186 bp, Dialister sp.
atggatatttcagaagaaatcaccaaaatgaatctctataaaacctttgagccctacatccacccatcggtgaccatgaaggaaagaatggccgggaatatccgtctcaccgaaacggcccccgaagacgcccgccaggccctttccaagtggaaggccatgaaactgaaacagcgccttttttaa

SEQ ID NO: 2036 - DNA, 186 bp, Dialister sp.
ctcttccttattgcttttctgtcttctgttttgggtcttgcattttcttctgtcttccatcggccgattttagaagaagggaggattgaaaagtggaattccctgatgtttcctcattcccccgtcattctccttaccgcggatatggaggatggccgtttggaaatcgggttcatcatctcatga

SEQ ID NO: 2037 - DNA, 129 bp, Dialister sp.
ttcttaaccatagctgcctcattatcccaaacccctgcttattgcagggaaaagggcgttcattacggaagcaccggttcattccctgcactgcataaaaaatcaggaatcaaagcagacagtcattga

SEQ ID NO: 2038 - DNA, 915 bp, Dialister sp.
atgggtgcaacatacagattactgaaaatgctgggctgggcggcctgccgtctttctccctccggcgccgatgccatgggaaggggactgggccgtttcttctggaccttcgttccgccgaaaagaaaaaaactggcggtggaaaatatcatccgtgccggagtcaccaaagacaggaaggaggcagaacagattgccagatcctcctcccttcgtttcggccctctggggatttccatgttccgttttccccttttgaataaggacaatatcaaagactatgtcaccatccggggcaaagaaaagctggacgcactgaaggaagaagggaaaggatgcattctggccgccacccactgcggtaactgggaagtggaaggggcggcccttgccttgtacggctatcctcttttatcagtggccatgcagcagaaaaataaggactttgaccgtttcctctgtgaataccgctctatgcccggtcagaaggtggagtataaaacaggagtaagggacatgcttagaaggctgaagcagggctacttcgtaggccttctctgcgaccaggaccccggcgacacgggcatcctttcccccttcctgggacaggaaaccctgtcgcccacaggccctgcccatttcgcccttctgacaggccttccggtcatgaccgccttcatccatgaaaccgctccctggcactatgaaatcattatcggcgagcccatttgtgccgatgagggacttaagaaaaaagaagccatcaaaaatattacggacaaggtgaatgtccggctggaagaatggatccggaaatatccggaagaatggttctggctccataaccgctggaaatggacagactatttctatccggagctgaaaggaaagaaatatgaaccagctcaacattga

SEQ ID NO: 2039 - DNA, 1218 bp, Dialister sp.
atgtttataaatttagtatccggtgatataatatggctgaaaggaggtcatggcatgagtgacttaaagatactgaaaatccattttgaccatatctctctatataatgaaaaaggccttactattgattttgcagcagctgatcgcgtttccgactttagcgaagtctttgaactaaaaaaaccgatttatacacagaaattgattgctctggccggaatcaatgcaactgggaagaccattgctctaaagctgattgatttggccatggctgttgttttaaaccattccagcctgaatgaagccgaccttttgggaacatcttatcttgaagatcagtccaggatgacagtcgatttctacagaaatggcatgatttatgaactggaatccatctttcagagagacagtacggaacgcctgacataccgggaagaatttatccgtagaaaaccgattcagtcggtaaaaaccaaaaaggatatttactcttttgacgaaactgaagtatggattcaaagatcaaatcttcaggaagaaatacaggccgttcttcaggatgatgacagcattgccattgtggcggctcgaaataatggcatcagcctgcggcagtccatttcgcttacgaatatgaatctttgggccacagtgggaaaagttccccaggaaatcctgcatgtattcgatcccatgctggatgaactggtgacggaagtccatggctccgacgtatcctatacagtaaaatttaaaaacagaaatcagccctatcagctgcataatacctatagccttggaaatctcatttcctccggtaccatcaaaggccagaatctactttccatgatgagagacgtgcttcataccggcggatatcttctggtggacgaattggaaaaccatatgaataaaatgcttgtgcagatgatccttgacatcttcaaaagcccccgaatgaatcccaaaggcgcctgccttatattcaccacccattatgtagaaatccttgatttagttgacaggaaagacgatatctatattgccagacgatccagagatgaacagaaactgctggaaattatcaactacaaggacgtagtgaaacgaaatgacgtaaagaaaagcgaagtctttctatccaactatataggcggcacggccccctcctatgaaaacatgattgctctggaggatgcattatgtcagaaaaaatga

SEQ ID NO: 2040 - DNA, 903 bp, Dialister sp.
atgcacctgggcaacctgtggattgccttcctgaactggctctggacaaggcagcaggggggaaccattatcctccgcatggaagacattgacaaagaccgctgccatccatcctatgcgaaaggcattctggaagacctcgcctggatgggccttgactatgacgaaggaccggaaggaacctatgcctacggaagcaccgtgcagagccgaagatacgacatttacgggaaaatcctttctgaaatggaaaagaaagggcacatctacccctgctactgcagccggagccgcatccaccaggtcctctccgctccccacgaaggagaaaaccgacctgtctacgacggacactgccgaaacctttcggcagaagaaagaaaagccatgaccaagcccccctgctggagagtggccatggaagaggggaacacgaccttttcggacctcttcttcggaaacgtgacaagacacctcaaaaaaggggccgacgacttcgttatccgccgcgccgacggccttgtagcttaccagctggctgtctccatagatgacggagccatgggcgtcacccacgtattccggggaaacgaccttctggactccacgccctaccaggtcttccttatggaaaaactgggataccagccgccagtctacggccacctgcccctgctcactgacaaaaaaggcatccgcctttccaaaagacagcggggcattaccatagaagaactccggaacagaggatacagccccgaagacctcatgggcctcctcctccacctggccggaggccttccggacatgagaccggttacaagaaaagaagcggtagagaacttccccttcgaaaaattgaaaaatctgaaacagaagcacattgtccttcctgtatcataa

SEQ ID NO: 2041 - DNA, 768 bp, Dialister sp.
atgaaaatcgcagaaatcagggatatcctaaagcaggatgatgtgccggacgaagtgatgaaggaaatcctggcagattcacgtaaaggggtgcagcagcttgtttcttcctacatgcgccgcctggagagggaaagcagggaaaggctgcgggtggagtctctctatgaagtggaaagcgaattctacaagcgggggcttacccatgtggtaggaatcgatgaagtgggaagaggacctctggccggcccggtgactgtggcggcggtgatattaaagccccactggtttgcggaaggcttgaacgattccaaaaaagtgacgccgaagcacagggaagtgctggcggaaaaaatccacagggaggcggtggaggtatccattgttagcctgccgcctgaggaaatcgatgccttgaatatttaccaggccaccatgacagccatgtaccaggctgtaaggaatcttcatgtgaagcccgatgcggttattgtagatgccatgcctcttcattttccatttcctacggtgtccatggtgcatggcgatgccaggagtgcctcggtggctgccgcctccattgcagccaaggtatacagggatcatctcatggatgcgtatgacaaacagtatccgggctatggcttttcccagaacaagggctatggaacggcggaacatatagaggctcttcaccggctgggcattacgcctattcacaggaaaagctttgagcctgtgaagaccatgctttacgaaggatggtaa

SEQ ID NO: 2042 - DNA, 696 bp, Dialister sp.
atggaaaccaggacctttcacgacggcgcgctggacgtgacactgtacaaagcaccgggagcagggcggattctctacattctggaaccggaaccggtggtgggaaaggtgagccatctggcagaagaactgtccctccacctggcggccatcagtggcatggactggaaccgggacctttccccctggccggcgccgaaagtatttaaaggggaagaagatttctccggcggcgcaggccccttcatggagcagctggaaacttccctctttccaaagaccgaagccctgctggacaggcccgtcgaaaaaagaatgctggcaggcatttccctctccggcctctttaccctctacatggccgccctctcccacaccctggacggcgctgcctccatctccggctccttctggttcgacggcttcaccgacttcatgggcgcccatcccctgccggaaaaaatagagcgggtgtacctctccctgggagacagggaaaagaaaacaggaaatccccgcatggcccaggtggaatccgccaccctggaaatcgaggaaatcttaaaagaagagggcgtggaaaccgtattccagatgaacaaaggcaaccacttcgtctacggcgccgaacggctggaagaagccgtccgctacctggcggaaggaaaagtgtggaaagggccgcatagtttgtag

SEQ ID NO: 2043 - DNA, 204 bp, Dialister sp.
atgatttccaatccctgcgccggcagggattttttcatgcagcccgatgaaagtccccgtcctcttcccgccggaatttatcagccggccggtgaggcctgtccgcttaccgccggcggtgtaccggtatccccgaaagcaagaagacggcagaccgtcaaacagtcagacgtcagacttcccgccaccggcattgacttacat

SEQ ID NO: 2044 - DNA, 1452 bp, Dialister sp.
atgaataagaaatcatttcaggaaaaagtgctgacctttgcccgccggcatggtttatgggccaggggagactccattctggctgccgtatccggcggcccggactccctgggactcctcctttttctaaaggaaatagaggggccggaaggcatccatgtgatatgctgctgcgtgaaccatcatctccggaaagcggcggaaggggaaacggaatacgtaagggaagtatgccgcctttttcatatcccctttatccggaaggacgtggatgttccggcggcaagaagggaaaatcggggctctgtggaaacggtggcccgcattcttcggttcaaggcacttaaagaagcggcggaagaaggaaagtgcactcaaatcgctctggcccatcatgaaaatgaccaggcggaaactattctcttccatctgcttcgcggaagcggcaccaaaggcatgaccggcatacagccccggaggaacattttcatccggccttttcttgctgtcacaagaaaggaaatcgccgatttcctttcttctttccatgtaacgccctgtcatgatgagaccaatgatattcccgatgccaccagaaataaaatcaggctggagctcatgccccggctgctttccttcaatccgaacctggtgaccaccctttccagggaggctcagatcttccgggatgaagaagatttcatggaaaaagaagaagaaagggaagcggtccatttcaaaagggaaggcacccttcttattttcccaagggcgagatggaatggcctccatccggccatgaagcgcagaatcatccgccgggcggtaatggaaatggcgcagcgaagccccgatgcagagggcgtggagcggatgaagcttctggcggagcagggaaaagaggggcagaaaacatcctcttccggcgctgtgctggaaatagcaggcccctttttctgcttctttccgggaagctccagaaatgattctatcaacgagggagatctgctctcctttttttataaaaatatggaaaaagaaaagcctgcagggagagaaactggtataataaaagataaccatgtggagaagctgacggcaggcccatgggtgctgacagtggaaaagctgccgcatccggtggaagcaggccgaaatcagtatcttcttgacgcctgtggggcaggggctctgaccctgcggatggcggaaaaggaagactacatggagcctttgggcatgacgggaaagaagaaggtgttctctattctccaggaaaagggaattccagcgcctcttcgccggttatggcctgtggtggctgatgaaaatcatatttactggaccgccttctttagaggaagccggttgtgcagggtgacggaggagacaaagtcatttctccttctgacactcaccttaagggataaggagattgaaccaaaaacatga

SEQ ID NO: 2045 - DNA, 1356 bp, Dialister sp.
atggaagaactgacaccccgtaagattgtagaatatctggaccattatattatcgggcagaaggacgccaaaagagcagtggcggtggcccttcggaaccgctggcgggccgggcagctgccccatgatatttcaaaggaaatcagccccaagaacatccttctcatcgggcctacgggggtaggcaagacggaaatcgcccgccgtatcgcctccctgacccatgcgcctttcgtgaaggtggaagccaccaagtatacggaagtagggtatgtcggccgggacgtggagtccatggtacgggatctggtggaagaagcggtgcgcctggtgaaaaaggaagaagcagcccttcacggcagggatgcagatgaagaggctctccgccgcattgcggaagctctgtggccttcgaagaaaccggaaacaaggagtcccatggatattatcttcggcgaaaagaaggaagataagccccaggatgaaggtgaaaaggaaagacgcagggaactcatcgaacgcatccgcaggggagaactggatgaccgcatggtggaaatcaaggtggaggataagggaaatgcccctgagtcggacaatgagcaggcaaaccagatttccatcatgatttccagcatgatgcccaaacggacaaagaagaagaaagtcaccgtggcagcggccaaaaagattctggccgaagaagcggccgatgaaatggtggatatggaagtggtgaaggaaaaagccatccactatgcggaggaaagaggcattattttcatcgatgaaatcgataaaatcgcaggaaggacaggcgcttccggcggcccggacgtttcccgggaaggggtgcagcgggatatcctccccattgtggaaggcgctacggtgaagacaaagtacggccaggtgaagacggatcatatccttttcatggccgccggcgccttccatgtatccaaacccagcgaccttatccccgaactgcagggccgtttccccatccgggtggaactgtccagcctgaataaagatgacctcaggaaaatcctgaccgaaccccggcaggctctcatccgccagtataccgcccttctggaaacggagggacttcaggtatcctttggggaagatgctctggatgccattgcggacatcgcccttcaggtgaaccgggaaaccgaagacatcggcgccagaagactctataccattctggaaaaagtactggaagacctttcctttgatgccccggatatggagcagaaggaagtggtggtggacagcgcctatgtaaaggaaaaactggggaaaattacagaaaacatcgatatttcaaactacatcctttga

SEQ ID NO: 2046 - DNA, 1281 bp, Dialister sp.
atgaaggtattagtcattggcagcggcggcagggaacatgccctgctctggcggctggcacggagcccttccgttacggaagtctatgccatccccggtaatgatggtatgagcaatgtggcccacctgattcccgtcaaaggacatagagatatactggactttgccagattgatgaaagtggatctcaccgtagccggaccggaaacggttctcaccgaaggtctggccgatgaattcgaagcggaaggactccctttcttcggcccctccaaagcggcagcccgcattgaaggctccaagggatttgctaaaaatctgatgaagaaatacggcattccaactgccgcctacgaagtatttaccgacgaagacaaggcagtggaatacctggtgaataaccggaaatatcctatcgttatcaaggccgacggcctggcggccggtaaaggcgtcatcatcgcccagaacgaagatgaagccatcagcacagtgaaagacatgctggaaggacactccttcggcggcgccggccggtctgtagtcatcgaagaatttatggaaggggaagaagcctccgtcctctgcttctgcgacggcacccacgtggtacctatggtttcctcccaggaccataagagaatcttcgacaacgacgaaggccccaataccggcggcatgggagcctatgcaccggctccggtgatgaccgatgaaatgatggacgaagtgaaagtcaaaatcctccgccccatcgtagcggccatgaaaaaagaagggtatcccttcaaaggctgtctctatgcaggccttatgattaccgacgaaggcccgaaggtggtagaattcaactgccgcttcggcgacccggaaacggaagcggtccttcccctcttcgacggcgacctggcccaggtgatgctggactgtgtccatgggaaactgaaaaaggaagacgtgaaatggaagaaaggctgcgccgtagacgtagtcatggcctctgccggctaccccggctcccactcctccggtgaagtcatttccggactggaagaagcggaaaaagccggatgcatcgtattccacgccggaacagtgaagaaagacggagaatacgtagtcaatggcggccgcgtcctcaacgtagtggccctggcgcccactctggaagaagccaaagccaaagcctacgaaggggtctccaaaatccactgggacggagttcagtaccgtcacgacattgcagacaaaggcatcagacatttgaaagataaagaatga

SEQ ID NO: 2047 - DNA, 1257 bp, Dialister sp.
atgattactgaaatcgtgaccaccggctccgagcttctccttggggagattgccaatgagaatgcccagtggctggcatcctttctgaacgaacatggttatacggtggcctatatgaccaccgtaggggataatccctcccgcatggaggaaacattctgccatgcccttacccgggcagaccttgtcattacctccggcggtctgggctccactctgggagacattacaaagaaggcgggagcttcggtgatggaccttccctatgttcatgtggaagaagaatcgaagcggcttcggaaatactatgaagataaacaccatccctttctgccctctctggaccggcaggcctggtttgcaaagggagcccatctcttcttcaatgaggccggctccgccagcggctcggcagtggaaaagggaggcaaaatccttatccatcttcctgggccgccctttgaaatgaaaaccatgatgagaaaccaggttatgccctggcttgacaggaagctgggctcccaggggatcatccgctcccttgtgctttctgctgtccatatgacggaagcggaaattgaagaaaagataggggacctgctccgggcccagtccaatcccaccatcgcccttctggctagaccgggttatgtggcggtcagggtgactgccaaaggggcggatgaagaagaaaccatggccctcatcgaaaagacggcaggtgaaattgaaaaaaggatgcctgtttcccgttaccatctggagggggatgtactccatgatcttcatgaattccttctgaaggaaggactgacggtgagcgcggcagaatcctgtaccggcggcctgatcgggaaattcctgaccgacaaccccggcagctcctcctattttaagggaagcgccgtgacatactggaacgaaacaaaggaaaaggtgctttccgtaaagaaggaagaccttgaccaattcactgccgtcagcgctcctgtagctgaagagatggcagaaggctcccgcagcctctacggcagcgatatagccgtttccaccaccggctacgccggccccggcaaaggggaacggggagaggatgccggccttgtgtatatcggtattgcaggctcttggggaacggaagtccacagagagcagttcttcggctcccgaagaagcgtacgttacggagcggcggaaaaagcactgtactacctgctgcagtatggaaaaaaagtgaaacttgggaagaacggttag

SEQ ID NO: 2048 - DNA, 1254 bp, Dialister sp.
atgaactctaccggtaaaaggattgctgtcatcggcgccggcgtggcaggcctcatggctgctgtcacctccgcccatgaaggggcaaaggtgctcctctttgaaaaaatgcccaaggtaggactaaaaatgggcattaccggcaaggggcggtgcaatctgacaaacagcgcacctattatggattttatttccaaaacgccgggaaacgggaaattcctatacagtgcctatgaaaaattcaacaatgaagacctgctctcccttttccacagctggggccttgccaccaaggtggaaaggggcggccgcgtatttcctaaaagcgatgatgcccaggaggtgcgccaccttttcatgaagcttcttcacagggaaaaggtggaacttcatctggaagaaccggtacaccatatcctgcagaaggacggcgctgcctgcagcgtggtgactgacagaggaacctatggggcggacgcggtgattctgaccaccggcggcgcctcctacccccgcaccggctccaccggcgacggctatgccatggcccgggagctgggacacagggtgacggccatcaggcctgccctgattcccctggtgtgcgctgaaagctggcccagagagctgcagggcatatccctcaaaaatgtaactttttccgtagatggagggggaagacggaagggagaggaattcggcgaaatgctttttacccatttcggcgtttccggccccatcgtcctgtctctgtcggacaaagtgtctctctggctctcccagggccatgaagtgaaaggggctatcgatctgaagcctgccctgtctttggatgtactggataaaaggcttatccgggattttgaaaaataccatctgaagcagatggcctctgccctggtggatcttatgccccaccggatgatcgatgtggtgctttctctggcagatattccaagagatcttccggtgagtgacctgaagaagggagaccgcctcaggctggccggtatgctgaagcatctgcccttaaccattaccggcacgaggccccttgctgaagccattgtcaccgccggaggcatatcggtaaaggaaatcaatccctccaccatggagtccaaaatctgcaaacatgtatatatggcaggagaggtgcttgatatccatgccttcaccggcggatataacctgcaggctgccttctccaccggtcatctggccgccctgtcggctgtaaaggagttatcatga

SEQ ID NO: 2049 - DNA, 1248 bp, Dialister sp.
atgaatcaaaaacttgaacaggtacagaaagaggcgctcgctctttgtgcgcctgtttttcatgaaatggaagagatttctctcttcaacacagaaaaagtattaaccgcattccgcaaacaccacctctccgcctaccactttgccccctccaacggctacggctacggcgacccgggcagagagaagctggaagaaatctggtgcgacatattccacgcagaaagcgccctggtgcgtccccagttcgtatccggcacccatgccctggctacggtccttctggcccttctccagcccggtgacaccatggtgtctgcggtaggagctccctacgataccatggaaagtgtcatcggcattacaggaaatgctccgggaaatctgatttccaaaggcgttcactacaaagaagtgccccttaagggaaatacctatgacctcaaagccattgcggacgcggtggatgaaaatacgaaactcgtagagatccagcgctcccggggctacatgctgagggactccctcttccctgaagatattaagaaaatcattgatacggtgaaagcaaagaacccggaaaccatctgctttgtggataactgctacggtgaatttacaaataaagaagagcccatcgaactgggcgccgacattaccgccggttccctcattaaaaacgccggcggcggcctggctcccaccggtgcctacatctgcggcagaaaagacctggtggaactctgctcctacgtatggacagccccgggactgggcgctgaaatgggctcctacgccgcttcctaccgccccttcttcgaaggcctcttcctggcgccacacatgacaagacaggccatgatgagcgctgaattctgcgctgcggttttcaagctcatcggcttcaagacaagccccgaaccgggtcatcttcgtactgacctcattactacggtcacactggactccgaagaaaatatgtgccgcttcgctgaagccatccagaactggtctcccgtagactccgacgccacccctgtgccgggacctatgccgggatacgtagaccctatcctcatggcagcaggcacctttgtccagggatccaccattgaaatgtccgccgacggccctgtgcgcccgccctacgtcatgtacttccagggcggcctcaccttcgaatccgcccagctggccatcatgggagctgcagaaaaagtgctggaagcccaggggaaattaggataa

SEQ ID NO: 2050 - DNA, 1242 bp, Dialister sp.
gtgataaaacgtatcattctggcagccgccatctgcgctgcccttggtgcctgcggcatggaaactgtgatggccgcaggagaacatagctccgaaaaagaagaagtcactgtcatcaaaggcaaagtactgcggacggaaaaagtgaagaaagaagacgtccataaggaaatccggcaggcagagaaaaaggaaaaggcaaagaaggccaaaaaggaaaagaaaaacgccctgcccgtgctgacggcagaaatgccggcgcccaaagcggaaccggcagccaaagcagcacctgccaaaaaggcagacgctccgaaagtacagccccaggaaaaggcggcagtggaaacggcggccaaagacacggaagcagtgaagaaagcgccggaaaagcccaggtttgaagacaaacgcattgaaatcaacctggccagccgcctcctcaccctctaccagggagacgtgggcatccgcatgtatcccattgctccgggcaaaccctcctctcccacgcccgtgggaagacggaccgtggtggacatggaagtgaaccccacctgggttgaccccgacagcggcacctccgtcccctcaggccccaactgccccctcggctaccgctggatcggcatcggaggcaactacggcatccacggcaccaacgtgccctctgccatcggtacctacgcctcccacggctgcgtccgcatgaacgaagcagacgtggaagacctctacgcccatatcgtaaaaggcatccctgtggacatcctctatgagcgggtagtagtgcagcgggaagcagaccacaccgtgatctactacatctaccccgacggctacggcagagaaccgctggacgtggccaaagtgaaagccaaactcgcccccttcggcgtggccgcctatgtatcggacgacgaagtggcccaggccatccgggcctccgacggcaaccccatatacgtggtgaaagtctatgatatgtaccttaacggaaagaaactggacgccagagcctttggcaaagacggacacatctacctccccgtcatgcccctggccagggcagcaggagtcaaagccgaatggcacggaaactggaacgaaatccgcaccccctacggcaccgccaaagccgtcctcaaaaaccgctccctcttaatcgacgcagccgacgcccccgccctcctgcacctggcaggaagcctggacaaagactacaactatcagatgaaataa

SEQ ID NO: 2051 - DNA, 807 bp, Unknown
  Description of Unknown: Proteobacteria bacterium sequence
gccgttttttcttcttcggattttgattccgatataaggttccgttcagttgtgcagaggactcattggagttatcaaagcctagaaaagataggtaaacccgaagaggattcgagtaaggcgaacgctaaaatagacaaaaattataaatgtgagagaaatgctctcaggagaaaaatgacagagaccaccgacaagccaaaagttatgagcgagcgcgccttaaaaacacgcgccaaaatcatggacgccacacgcgcgttcattgtgagagaaggagtcggccgcctctcaattgacaagatcgtcaaagaatccggcacgagcaaaggtgcttttctttatcactttaaaaaccgtaaagcacttttctgtgccttagttgaagaatacgttgaccatttaaacgaacgcatgaacgcccacatgggcaagtatcagaactcagaggaacctttgattcttgggtacgcctcttggtatgaggacttcgataaagatgacggcggctatgccgttctcggtgttgcgctgttggcgcttctcctgcacgagccggacgcattgaagccgttccatgactggtacgccaaggtctttaagatggtccaggattctccgatcaaaacaccgcagcttctgacagccattatggcctttgaaggtttcttctttacgcacaagatgggctttgactcattagataaagaaaccaaagaggcgacctggaggtacatcattgagcaagtggctccgcagccgaaaaagaaggcgtccaaatcaccggacaaaaagctccctgcctaa

SEQ ID NO: 2052 - DNA, 1209 bp, Unknown
  Description of Unknown: Proteobacteria bacterium sequence
atgaatctctataaatctattcttccggttgatgaaaagggcttttacggtgaattcggcggcagctttgttcctcccgagcttcagaaaaacatcgatgagctgcaggaagcttatcttcgttatgttgatgaccccgaattccagaaagaattcaatgaccttctaagagattacgtcggtcgtccgtcccctctttactttgctccgcgcctttccgaaaaatacggcaccaatgtttatctcaagagagaggatctgaatcacaccggtgcacataaaatcaacaacgcaatcggtcaggcactcttagccaaacgcatgggcaaaaagcgaatcattgccgagaccggcgccggccaacacggcgttgctaccgctaccgtgtgtgctcttatggggcttgaatgctctgtctatatgggagagcttgacattcagcgtcaaagaccgaacgtggaaagaatgaagatgctcggcgcaaaggtgattccggcgaccagcggatcgaaaacactcaacgacgccgtcaacgaagccctcgaagcctggatgaaagaccccgaaaacttctatttgatcggttcagctgtcggtccccagccgtatccggaaatggtggctcggttccagtccgtaatcagcgaagaaattaaaaagcagctcaaagagaagaccggtaaagaaaatcctgattacgtcgtcgcttgtttgggcggcggaagcaatgcggcaggcgctttctaccactttatcaacgagacgtcagttcatctcattgcagccgaagcagcaggcaagggcgttgacagcggagaaactgccgccactctgactatcggcgaaaaaggaatcctccatggttctcagactatgttgatgaaagacgaacagggcaacgttaaggaggcttattctctgtctgccggcttggactatcccggtatcggaccgttgcatgctcatttggcaaagaccggaagaatggaagttgaagcagtgacagatgatgaggcgttaaaggccgcattcatgctgacacgagaagagggcattattcccgctcttgaatcgtcccacgcgcttgctgtcttggaaaagagaaagttcggaaaagacgacgtcgttgtgatcaatatttccggaagaggcgacaaggacctggataactatctgagcagttcttttgctcagggagccctggaataa

SEQ ID NO: 2053 - DNA, 645 bp, Unknown
  Description of Unknown: Proteobacteria bacterium sequence
atgggatacacactgcaagtgatgcctgagagccctcagcctcatcgcatcgaacaagccgccaaacttctttcaaagggacaggtcgctgctgtttctaccgataccggattttctttggtttgccgtttggatgacaaggaagcgctggacaaaattcgtttgattcgtcagctgagcgagaagaagcacttcacgcttttctgtgactccttgtctcagatgagcaagcttgctcgagtcaataacaccggctaccgcatggcaaaaagtgtcacgccggggccttatacctttattttggaagcgacaaaagaagttcctcgccggctctctcatccgtctaaaaaaacaatcggtttaagagttccttccaacaaagcacttcatgctttactggaaaagatcggtgaaccgcttgtcggtacgacgatcatcatgccgggcgaagaagcaccgctttcttccgcttgggaaatccaagatcgaatcggagatcagctggcgttcattttggatgacggtacttccgtgatcggagatacgacggtggtcgatctttccggagacgaacctgaggttatccgtgaaggcttaggctcggtttcggctttaggctttaggtctgtagtcagccttccttaa

SEQ ID NO: 2054 - DNA, 1434 bp, Unknown
  Description of Unknown: Proteobacteria bacterium sequence
atgaaagatgatattcagacttttgacgtcgtcgtcatcggcgccggtcccggaggatatgtttctgcgatcagagctgcacagctcggcctgtcggtatgctgcattgatgattgggtcaccgacggcaaacctgcacccggaggtacctgcactaatgtcggctgcattccctctaaggctcttcttgcgagcagctgcctgttcgaagagatcagagacaaagcttccgagcatggcattcacgtcgaaggaccttcaattgatgtcccgacgatgattgcccgcaaggctaagatcgttcgacagaccaatgacggaattctttatcttttccgcaagaacaaaatcacattcttaagcggtcgcggattctttgtgacttccgacgaagacggctatttgatcggcgtggaaggcaaagacgaaacacgcgtgtttgctaagaatgtggtgcttgccacgggcagcaaacccagacagttcccgggcgttccctttgacgaagaacgtattctctccaacgaaggcgcactgaatttaaagagcgttccttccaccttaggcattatcggcgccggcgtgatcggcctcgaactcggcagtgtctggaaacgcctcggtgccgatgtccgaattcttgaagccatgcctacgcttctgccttttgcagattctgcagtgagcagagaagccctgaaggccttcaagcagcagggcgtcgatatggaattcggcgttcacatcgacagcatcaaaaatgacggtgaccgtgtcattgtccaatataaagataaggacggaaaaaacagtgaaatgtgggttgaccgcctgatcatttctatcggccgtgttccgttcacagcagccttggatgcgccagtcgtcggtcttaagctcgacgaaagaggttttgttgaagttgatgcagaaaaccgcacgaaccttcctcgggtgtgggcgatcggtgacctcgtcaaagggccgatgcttgcgcataaggctgaagaagaaggtgtggcggttgcagaaagaattgcaggacgcaaagcgataacgcacattgaacgtgtgccttccgtgatttacaccgaaccggaaattgcctgggtcggcaagaccgaagaggaattgaagaacgccggaagggcctataaggtcggcgtcttcccgttcatggcaaacggtcgggcgcgagccgtcggtgaaacgcagggctttgtgaagatgctggcagatgcggagaccgatatggttttaggtatgcacatcatcggtccgcaggccggcgagctgatcgcgcagggctgtgacgctttgtctttcggcgcaacggcagaggacatggcactgatctgcgatcctcatcccacttttagcgaggctatcaaagaggcagccttggcggtaaataaagaagggattaacttttag

SEQ ID NO: 2055 - DNA, 882 bp, Unknown
  Description of Unknown: Proteobacteria bacterium sequence
atgattaaaggcagtattgttgcactggtctcgccgatgttcgaagacggcaccattgactacgactcttaccgcaacctcattgaaatgcacattgccgccggcacgaacgccatcgtagccgttggtacaaccggcgaaagcccgacggttgattatgacgaacataacgaactggttcgcgtagctgtcgaaacggccgccggccgcatccccgtgattgccggcacaggctctaactccaccaaagaagcgattgagctttctgcctacgcagcctcagtcggagcagatgcaacacttcaagttgttccgtattacaacaaaccgacacaggaaggtctcttccagcatttcaaggcgatttccgaagccgtggatattccgatcattctctacaacgttccaggaagaacagttgctgatctgaagaacgacaccgtgcttcgcctcttggaactgccgaatgttatcggtttgaaagacgccaccggtgatttgggccgcgcttccgaactcttgagccgtctgccgaaagaccgtgaatttgcgatttacagcggcaacgacgattccgcgcttgccttgatgctgatgggcggctccggcgttatttccgtgactgccaacgtggctccggaactcatgagccgcatgtgtgcgatggctctggccaatgatgtcatgggtgcccgtgaaatcaatgatcgcctgatgcccctgcacaaagaactcttctgtgaaccgaacccgattgttcctaagtgggctctccacagaatgggtctgattcctccgggaatccgtcttcctctgactccgctttccccctctaaacacgagcaggttgagcgagcattgatggtcggcggatgcatctaa

SEQ ID NO: 2056 - DNA, 1662 bp, Unknown
  Description of Unknown: Proteobacteria bacterium sequence
atgaacgattggctgactcgagtctctgccgccagcggtatcccctctgaaatctttattcttggcttcattgcattttttctgctgattgtcttagtcatcggccttatctactgccttatcagactaaaaagcatcagtgcgaatacgcttcagacggttgcccaggctcggatggcttggcgggaagatttgggtgctgcggttacccaaagtaaagatctgattgccgatcgtatgaaaccgagttttattgagacagaacggacgctggagcgttctttccaagatgtttctgccggaatccgaagcgaaacctttgccagcctgaaggctgtgcaggacacgcttaaccagtctcttacacgtaatgatgagcaaatcagttcggtaaacaagcgctttgaggagttatccagaagtatccgagaagagattgcagaaagcggaaaagtggtccaaagcacattgaaccaatcgctgattcgaaacgatgagcagattaagagcctgaatgagcgttttgaagaactctcgaagacgctccgcggagaaattttttccaatctgaaagccgtccaagatacgctgaatcagtcgctcacccgcaatgacgaacagcttcgcggcgtgaaccagcgtttcgagactttgtcgtcgacgttaaacacttcgctcaacgaactgcgcaaacaggtcgatgatgatttgaaggttctaaataaagacaatgaagccaagttagaaaagatccgagaaaccgtagaagagaaactccaaaacacgctgacaagtaaagtcggagaaagcttctcccaggtgactcagcagttaaaccgcgtctatgaaggtttagggcagatgaaagagttggccgaagaagtgggcgggttgaagcgcgtttttgtcaacgttaagagccgcggcatgctcggtgaagttcagcttgaagcactgctgaaggaatacttcaccgagagtcagtatgttaaaaatgcccatccggttccgtctaaaccgaagatggtggttgagttcgccgtcaaactgccgggcttaaatggcagaacttgtctcttgccgattgatgcgaagttcccggtagaggattaccagagactcctgcaggcagccgatgaaggcgatcgagaaggtgttgcggaggctcgttctaaattaagagcgcgttttagaaatgaaggcaaatcgattgccgagtacatcaatgtgccggagaccacagattttgcgattatgtttattccgtcggaaggactttatgcagaggctttggcgctggaaggtttgaccaacgaactcttcacgtcttaccgcgtatacatcatgggcccgtcgacgctggcgagcgccctttgtgcttatcgcgccggtttccagacgctcgcaattgaaaagaagagctcggaaatcagaaagatcttgtcttcagtccagacggaatttgcgaagtacggcgaagtcctaaataaacttaaatctcaggttgaaacagtcgttaaaaccgtagatatcgttcagaacaagacaaggaagatgaatcttcagctggaggtcgcgtctgagagcgataaagaagaggaccagccgatgtctctgccgtctccgatttcgaaccagaactcgctgacttcggagtcttag

SEQ ID NO: 2057 - DNA, 1272 bp, Unknown
  Description of Unknown: Proteobacteria bacterium sequence
atgagctgtaaattcccctccttgctgaaatgctttcttttcaccttgaagcaagcgaccactaaccttgcctgcgctcccttcttctgcttcgcagtatttttctattctttctattactgctggccatacatggagcagctgcccgaccatttgaatgtcgtggccgttgaccaggacaactctgcgctgtccagacgcctcactcaggccatgcgggcctctccaaatctgcaggtcactcagcagacgacgagtctcccggaagcacagaatttgatgcgcaagggcggcatcagtgcaattctgatcattccgcctaattttgaaacgcatacgctcaccaacgttccgaccgctttagtcctcgtcacaaacggcgctttcattgttaagagtcgaggctcgatgagcggtgtcggcggtccgcttcagaagattgtagcggcgtccatcagtgctcatctggttgaacatggggtccctttgtccgagatcgcgcgagccgccaataatccgccctcgatgatcgtggaaagcatgtttaatacggtcaacggatatctgaacttcacggttccgatcgtcttcatgatcattttccagacgattttcgtctgcggcatcggcatgctgatgaacgattggttctggaagagaaaatatccgttcccgctggcgcttggcgcccgccatccgatgtacttccttgcgatgtacgcaccgtttttcttcctgagtcttttctggatcttattcattgaggggcagtccttctctttccatggtgtgaattcgtttaagaacgttcccggaaccatcgtggtctcgatgatttatgcttttgcgattacgtctttgggcatgctgatagcagcgctgctcaagcgttaccgttttgtggttcagatagttgtgccgtcttccattccgtttgtctttatttcgggcaacctctacccgtggcagaacatcccgtggcctctgcaggctttcgggtggctgtcaccgacgacggcggggtccgttgccatgcttcgtgtttcccaggccggcgccacgctgtcaggtgttgcattcccgtatttaactcacctattgcttttgggcgcggcatttctcacagctgcctacattctgatttacaagacccagaatgatccgcagtcacttgctgagatggaagatctcaggaaaggcattgtggacgaaaaacttgcccctgagctcacccctaagcaggaaaaagaactcaccggaaaggcggtttag

SEQ ID NO: 2058 - DNA, 762 bp, Unknown
  Description of Unknown: Proteobacteria bacterium sequence
atggacatcactcttaccgtcatactcgtctgcttcgttgttttctttattgcaggctttatcgatgctattgcgggcggaggcggtctcatcacaatgccggtccttttgctcttaggcgttcccgctcactacacgctcggaaccggaaagctcgcttccagcctcggttcaattacagcgttgattaccttctggaaaagaggcgccgtcatcaaagaagtcgtcctgttgggcgtgattacttcctacttcggcgcagtaatcgcctctgcgacgacacttctcatttccaatgagaagatgacaatcatcatgatttttcttctgccagttgcgattctcctttcgcttttttgcggaactctcaaactgacggaagaagaccttccgaagaaagggttgtggtggagagtctcggtaatcggtttgtccgtcggtttctatgaaggctttttcggtccgggcgccggaagtttctttttgatcggcattcacctcttactcaaggccggtctggttaaagcttccggtacggcaaaatcatttaatatcgccgccaatttaggtgcggtcacaacgtttgcttccgcaggaacgctttattactcgttggctctcccctgcgcggttgccagcatcttgggcaaccgcttaggcgcaatctatgccgtcaaaatcggtccgacgctcgttcgcagcatgctctactttgttttagtcatgctgctgctctcgctgataactcgctttgttatttaa

SEQ ID NO: 2059 - DNA, 1107 bp, Unknown
  Description of Unknown: Proteobacteria bacterium sequence
atggacactaaagattttgatgtagtagccatgagaaccgatcttcaccagatcccggaactcggcttcaacgaacacaagaccagtgactacgtcgctgccaaattgaaggaaatgggtcttgagccgatccgcggcatcggcggaaccggtgtcgttgcctacattgacggtacagaacccggacccacagtcatgctgcgtgccgacatggacgcccttccttttgtcatcgacggaaaggacgcctgcattcacgcctgcggccatgactctcataccgctatggttcttgcgacagctgccaagctgatcggtcacgtcaagaaaggccgcgtaaaactcttcttccagccagctgaagaaaccctcttcggcgctctgaagtcttatgatgacggcgtcttagatgacgttgactacgccttcggtgctcacgttcgtccgatccaggacattcctgacggcaccgtctgcgcagctgttcgtcatacttccagcacattctgcatcgtcgaacttaagggcaaagtcgctcacggctcccgtccgcacctcggcgccagcgttgttgaagcagccgttctcgcaactaatgctgtgaactccatttgggtcaacccgaacaaggcctggtctgctaaagtcacttccattgactgcgcttctacagccaccaacattatcccggacaaaggcaagatgattcttgatatccgcgcccaggacaatgaaaccatgaacgagctgcttgaaaagctcaagacagccatcaccaatgcctgcgcctgcgtcaacgtcacctgcgaaatcacattcccgggcggcgtgattcctgcagccgtttacgacgaagacttagtcgaccaggttcgcaagaccatcggcgaagtactcggtgaagacaaagttgctaaagactgcggtggcggcggagaagacttccactacttcaaacagaagaagcctgaacttcatgctgcatacatcggcgtcggcactggcgttacaccgggccttcatgatccgcgcatgaccatgaaccccgaatctctgagaaacggtgtcaaggttttggaaagattgattcttaatgttgtcggctaa

SEQ ID NO: 2060 - DNA, 558 bp, Unknown
  Description of Unknown: Proteobacteria bacterium sequence
atgaagactgcatttcgttggtttattttttctgtcagtcatgtggaagatttccacgggcgcgccggcagaatcgaagtttggtgcttcttcgtttttgagtgcctctttctggttttggcagccggaatcgatttgctgtttaccggatttccgatcgtcctgccgatttatgcggcgctgacatcaattcctaccgttcttttatttatccgccgcctgcatgactgcgggttttcgggttggtgggtttttcctgctatagttcctccgatttgcttttttgttatgtgttgggcgcctgatccggcacagccgaataaatacggcacgaccgaacgtctgccctcgaagaatctgcgggaacagtcggtgcctccgttaattgacgggattgagtacctgacgccgcctccgcagccttatgaaccggcagtaaagagacgtgaagaactgtttgaaaaagagcagcaagagattattgaacaagagaaagtttctacccgcaaggagacagcaaatgaaaaagacatccgccaaacaggccaaaaagattga

SEQ ID NO: 2061 - DNA, 1311 bp, Unknown
  Description of Unknown: Proteobacteria bacterium sequence
atggcaacggaaatcaaagtcggtttggccgggttcggtaatgtcgggaaaggcacctacgacatcttaaaaagaaaccactctttaatcggccaaagagcaggcgctccgatctcggtcaaacgcgtcaccgtccgcaacgtcgaccgtgttaaacctttggtcgacgaagacgtgatcgtcaccaacgattggcatgacctggtcaacgatccggaagtcaacgtcgtggtggaagccatgggcggtattgagcccgcaaaatctttgattttggccgccattaacgccggcaagcatgttgtgaccgccaataaggcgctgcttgccgagcacggcaatgagattttctctgctgctctggctaaaggcgtcaatgttgcatttgaagccgccgttgccggatccattccgatcgttaaagcgctgcgtgaaggcttagccgccaaccgagtctcttcgatcgccggcatcatcaacggaacctgcaactttatcctctccaccatgcgtgataccggacgcagctttgacgatgtcctcaaagaagctcagcgtttgggatacgctgaagccgatccgaccttcgacatcgagggtacggactccgctcataaactgatgcttctgtcggccattgccttcggcgttccggtcgatatgtctaaagttcatatcgaaggcattacacatctggaagccaaggacattaagtttgccgaagaactcggctaccgcattaagctgctcggcatcacgaagtacaccgattacggcatcgaacttcgcgtccatccggcacttgtccccacacgccgtctgctggctaatgtggaaggcgcaatgaacgccgtcgttgtgaaaggcgacgcagccgaaagttctctttactacggcaagggcgccggctccgagccgaccggttctgccgtggtggccgacttgatcgatatcgccagaactgcggaagtagcagtctccgagcgccctcgcatgccgacgacaacgcacaacccgaaggccaaatcttttgccgatttcggcgacacggtttgctcttattaccttcgcattccggttgaagacaagcccggtgttttggctgagatcgcccgtattctggccgacaacaagatttctatcgagtctctgattcagaaagaagcgcctctggaagatgcttccaccgaaatcattctgctgacgcacagcactcgcgaagcggatatccaaagagccatccgtacgatgcagcagcttgccaatgttcgcggcgcaatcgtgcttctgagaaaggaagaattacagtaa

SEQ ID NO: 2062 - DNA, 813 bp, Unknown
  Description of Unknown: Proteobacteria bacterium sequence
atgcgtttcacttctccgagtcgtacgatcccttcgatctgtttggcaatctatggttgcggacagctcgatcgtgttgccgacttcatcaacaacagcggagagtatgttgaggacggagtaacttttacgccgggtatgattgccggccagtatgcatttgaacaagtgaaacttgaccgtaaaggctatgacactcgccgtctgcagaaatatctttcttttttggcagacgccggcgcattcttttccgaagaagaagccctccagagagccgatgatctgatcaacaatttcacagccgatttcggacacgatgaggacggtgacgcaactttccgtatcaaggcacagagctatcgcttgaagaaatatgattgtcatgctttatggagcatgatcaaccaggcttccttaacaatcgagagcgttaagcctgaaactttctgcgatgaagacagcgacgaagatatttcttccgattctttggatctggtacttacctctcgccttttcaacaagcagaacgaagccttcgctactctgactcagtactatacggtcagcgagggaatgctcaccgtcgaagatttgcttgattattcacttcttgactaccctaatttccatgacgagagcggtaaaacctacaatctcatggaaaacattgctcagcgctactacaccgaatgcattaaggtcgttatggattacttccgagacgcgcataaagagcttccggatgtcatccgctcagaggaaattacctccatgatcctgcagccgatgaaacttccgatcatgccgaattaa

SEQ ID NO: 2063 - DNA, 768 bp, Unknown
  Description of Unknown: Proteobacteria bacterium sequence
atgacggacgtttttattcctatcgaacccgaagtgacggataaacctgccgaggaactcttggtaggaggcttaacacgtatgacaaccatcgactttccggattacctgtctgccgtggttttcatcaaagggtgtccttggaagtgcgtttattgccagaacgaagatctccaaagtcgagagatgaacgagggggacggctacgtttcctgggcatacatcgaccatttcctcgatagaagaaaaggtttaattgacggcgtggttttcagcggaggagaaccctgtgttgatcccgcgcttcccgatgccgttaagagagtcaaagagaagggctataagatcggactgcataccggaggaatgtatccgcgcagactgcgggcggttcttccctttttagactgggtcgggctagatatcaaggctcctttgtctgatgaagccgcttatgaaaaagttgtccgccgtaaaggcgcagcagcaaaagttcgttcctctctggaaatgctgttagaagcaggtgtttcattagaaacgcgtacaaccgtacatcccgaatatcacactgaagagcagatccttcagctcgcacgagagctttctgacgcaggtgttgaaacctatgcgctgcagatttatcgtcagcccagagggcttccggaagagcatcttcttgaacgagtcggaagcgattacccgcatgaagagactctaaaaacgctcgaatcattgtttaagaaatttatttaccgcagaagttaa

SEQ ID NO: 2064 - DNA, 612 bp, Unknown
  Description of Unknown: Proteobacteria bacterium sequence
atggctgagctcaagattgagaaagttactgaagacagtcctctgaaagcgaaagttcagcggatctatataaagtcttttccgctctttgagcgagtttctctcgaacctttctttaactccgtttccgacggcgtcgaaatctttgcgctgagcgatgaagaagacgtggttgcttttttctgcacgctcagaaaagacaagtattactacctcttttatcttgcggtcgatgaagataaacgaggaaaaggcatcggcagcgacatcttgtctgccgtcattaaaaatgcccgtggtgcgaccgtcttcttagactgcgagggcatttatcccggctgcaaggacagagcggcacgtgttaaacgcttgtgtttttaccatcgcaacggattcaaagaaatcggcccgctgaagacctggcgcggagagaaattcagaacgctggtttacggcgacaaagaaatctcggagcaggaaatcgaagatttctgggagatttttggtcatttgtgggaagggcaggagattgctactatccccgccgagcagggttctcaggatgggcaaactatggagaagacctatagaatgttcgctccaaaggtctag

SEQ ID NO: 2065 - DNA, 627 bp, Unknown
  Description of Unknown: Proteobacteria bacterium sequence
atgaaaaacaacggcagcttcaaaaacgccggatcttcccgcgccaagatgtggagaaacatcctcttgatattgggggctgtcgctcttatcgccagctattttgctgatattcgcgatccgcatcccgggaccgaaactcaggacaatcggccgtacgttgaacaagctcataaagacgggtttcaaacactgcatgcccgcgttactcgtgttgccgacggggatactgtttatatcaaggatgacgaaggaaaagaagctcgcgttcgacttctcgggatcgatgcgccggaaagcaaacaagcctatggtgtccaaagtgccgaacatttgaagcgcaatcttcgggatgctgggtatcacgttcaagtgatttaccgcggcagagatcagtacggcagaatcatcggtaaattggttgctgacggaaaagatctgaatctcgatcaagtcagaaccggaaatgcctgggtctatagaaattatttgcgtgaccttcagcccggagataaaaatctatatctcaacgcagaggaaaacgctcgtgccaagcgaatcggtttgtgggccgatccgaattcgcagaatcctcgggattggcgaagagatcatccgagaaattag

SEQ ID NO: 2066 - DNA, 450 bp, Unknown
  Description of Unknown: Proteobacteria bacterium sequence
ttgattgttgaaagaatcttaggtgggatgaatgaaacttctgagcgctgccgccgcaatctcagcttgtttacttatgtccggaaacatcatggccaaaacattcagatcaaagtcgacgacaaagcctttacgggagagttgaacaacaacgatgccgccaaagactttgctgcaaagcttccgctgaaactcaaatttgaagatttcggaacgacggaacggatctcttatcttccgaagcctctgagtttgggaactgctccaagaaactgtgatccgcaaaaaggcgatattgcttattacattccttggggaaatttgacggtttttgttagagatttccgcccgtctgacaacttagtcccgttcggaaaactttcttcaaaatcgcttgaggccatccaagaaagcggctccaaagatgttgaaatcagtcttgttaagtga

SEQ ID NO: 2067 - DNA, 1227 bp, Unknown
  Description of Unknown: Proteobacteria bacterium sequence
atgacgaaccaaattcctacgatcatcctcaaacccggcaaggaacgtgcgctccttcgccgtcatccctgggtttatgcaaccggggtttccaaagtactgggaaaaccgaagagcggtgagacggtcaggattcaggacagcaagggaaaatttttagcttggggcgcgttttctcccgaatctgcactccgcgcccgctgctggtctttccaagaagaagacgtcatcaatgctgcctggatagaagccagggtcaaggctgcgattgaggcgcgcagctgtctgagatcccgtaccaatgctattcgtctgattttcggagaggcagactttcttcccgggctgattgttgatcaatacaacaatcaagttgtgacacagtttcaatccgcgggcgccgagtattggcgctccgagatcgggcaggcattggtgaagtacaccggctgctctcaggtgtacgaccgttccgacgctgctacccgagctcgtgaaggtcttccggaacgcaaggaggtccttgagggcgaagagccgcctcaggaagtcgaaatcgtggaagacggaatcaaatacggcgtcgacgtccgcatgggccataaaaccggtttttacgttgaccagcgcgacaaccgcgctttggcccgcagacttgccgaagaattcaagaaagttcacggcagaggcatgagagcgctcaactgcttctgctacaccggcgggttctcgctcgcgctcaaagccggcggtgccgaagaagtcgtctctatcgactcttctgccgacgctctgcagatggcccaggaaaatgccaaacgcaacggctttgacgacggctcgatgaagtggatcgaagcaaatgtcttcgaagctttgagagaatttcgcgacaaaggagaacaatttgatcttgtcattctcgatccgcccaaatttgcttccagtcatcatcacgtagacaaagcagcccgagcttacaaggacatcaaccttaacggactgcgtattctggcccccggaggacagcttctgacattctcctgctcgggtgctattgacgtcgacttattccaaaaaatcgtagcgggcgcagttattgattcacgcgtggaggcctggatgatggaacgtctcggagcggggatagaccatcctctgctgatgactcaccctgagggtgaatatctgaagggattacatcttctctcgcgcggcaccgtctag

SEQ ID NO: 2068 - DNA, 639 bp, Unknown
  Description of Unknown: Proteobacteria bacterium sequence
tggggcaggccatcgttcagtggttcatttagtttgaggacaagcatcatgagagcaccatatattccgtccgagcatgttgttaaagggttaaacgcagaaccttcggcatggattaagcgtttttgtccgctcttttctcccaacgccaaggtgctggatatggcctgcggcgccggccgaaacaccaagcttttggcgtccttcggaaaccaagtgacgggattggatattgatgagcgctgcagaccttacattgaagcaattccgggtgcgacttttatgcaggcggatttagaaggggccccgtggcctttcgaggatgaagtctttgacgtcattgtcgtaagtttctatttggagcgttcgctgtttccgcatttggttaaatctttaaagcagggcggatatcttatttatgagacgttcatgctccccttcgaaggatttgacggcaatcgcgcaaagagtccggattttgtgctgaagcctttggagctcatcgatgctttccgcgaaacgatggaagtgttcgcatacgaagagtcgcttattgagaagggcgactgcttccagcggtttgcggcgagaaagccaatcaacgggaaaaatgttccggtgatcctgccaaaagaataa

SEQ ID NO: 2069 - DNA, 360 bp, Unknown
  Description of Unknown: Proteobacteria bacterium sequence
ttcctaaaagcctatagttataagcctccgttcgccgcggaggctttatttttgggagaaaaaatgtctgatatcgaaatggacccgctggctaaccgctcatcttccgggttggattacagcacgcttttagaaaaactcctgcagcagaacggatattcctccgataacagcaaacatgggctaaagagcgcgctcaaagactatgaagccgtatttcataacggtgccccgaaatggctcgatcttgtttggccttcgatcggcgtgagccttgtccacttagccttgtcgtttaaacagcctcttccagaacaggttaaccttccgcaagaagcattaaaaaacggtcttcactaa

SEQ ID NO: 2070 - DNA, 972 bp, Unknown
  Description of Unknown: Proteobacteria bacterium sequence
gtgagtactgtttccgaccttgatacctggcggcttttctttaagatcgtctcccgcggttccatcgctaaagtttccgaagaaatcggcgtagaggcctcttccatctcaaggcgaattaacaaacttgaaaaagatctcggcgttgaactttttcagagaaaaggcaaacagctggtgctcaccagtgccggatctgtggcctattcccgcatgagacgtatcgtttttgatgcggcctcattgttcaaagaccttcaggttgctcgtgataatgacagggacttgataaccatcgcctgccctattgggctctctgaaatcatcatgccgattgcaatttcaaagtacctggaattcaatcctgatgtttcagtgtctatgagatcattaagttatgttgagttaatgacctctgacgccattaccagttatgacgtcatgctctcgataacaccgctgaatattccgacacgtgactctaaactgattgccggtatttccttcatgctcgctgccactccacagtatctgaatggacttaaatatccgattcgctctcctcgtgacctctctgaacatcctattttctctttcttttccagaaaccgcgaaagaaatatggttttaagaaaaggaagcgactattttcccttgcacttccatgcccatatgcgtttgaataatccgggaggcatcaagcaggtcgtcatgcgttcaaagggcatcggagcctactgccctgtctattactatttagatgagctggctaacggaacggtttgcgaagtcctgccggaatggaagttccccgtccagcaaatctatatcagccgtaaagacagagacagagttgcagtcaatcggtttgtccattggctaattgagtactttgaacattgtcccggactggtgcctccgagctacgaaggtctctgggtcggtgacttcgttgacggagcgccggtgtga

SEQ ID NO: 2071 - DNA, 1215 bp, Unknown
  Description of Unknown: Proteobacteria bacterium sequence
atggcggaaatgaatcagacccccaaaggtatgcgtgttcatatcggaattttcggacgaaggaacgccgggaagtcgagtgtgatcaacgcgctgaccaaacaaaacattgcgcttgtcagcgacgttgccggcacgaccacagatccggtgtttaaagcgatggaaatcctgcctctggggccggtgatgatcattgataccgccggcatcgacgatatcggagatctgggcaaacttaggatcggcaaaactaaagaagtcatgactaagaccgatgtcgcggtcattgtgattgacgcggtcaatgacgtttctgactttgaacgatccttagtttctgagtttaaaaaactgggaacggcctacatcctcgcagccaacaagattgaaacggttgccgatcctgccgagcggattgctgccttggaaaaagttttcggagaaaaagtcgtcccaatcagcgcgctggagaaaaaaggcattgatgatctgcgctcgcttatcgtcaaaacagcaccggaagctttcgaagacggtcccatgcttcgggatcttgtcaaagaaggcgataccgtcgtactttgcgttcccattgacacagcggcacccaagggtcgaatcattcttccccaggtgcacgctatacgggatattttggacgccaatgccaaggcagttgttgtcaaggaaaatcagctcgccgagcagcttgtaaaccttaaagaaccgcctgcattggtggttacggacagccaggtctttgcaaaggctgatcgcgctgtacccaaagaaattccgctcacatctttttctattctcatggcgcgtcaaaagggcaatttaagcggattagccgccggcgccaaagccgtggagaatttgaagccgggcgataaggttttgatagccgaggcctgtactcatgtttgtcaggcagaggatatcggcagagtcaagattccggcttggctgaataagaaagtcggcggcgagctggactatgaatggtatacgggagattctttcccggaagacgtttcagcgtaccaacttgttattcactgcggagcctgcatgattaaccgccgagctatgctgagccgccagagaaaatgcgccgaggcaggcgtgccgattgttaactacggcgttctgatttcttatttacacggaatcatgggtcgcgctatgtcgccaatgcaagacaactaa

SEQ ID NO: 2072 - DNA, 483 bp, Unknown
  Description of Unknown: Proteobacteria bacterium sequence
atgctggatattattctttgggtcatcgccgctgccctcatggtcagcggctttgcaggcaccattgtcccgatgattccgggactccccctcatctttgccggggcttggctggccgcgttcatcgatcactacgacgagatcagcgtaatgacgctggtgattcttgcagtcctaacggttatcggactcattgtcgactgggtcgctcagaccctcggcgcacaaaaggccggagcaaccaaactcggtattttgggctccttcatcggcacactcatcggtatctttaccggtttgtgggggctgatttttatgccgctgctcggcgccgccatcggcgaatttattgatcaccgcgaccttctcaaaagcgggaaggtcggttttgccacatggctcggaatgatgatcgggatcgttattaagctcggactggcctttacaatgatcggcattgtaatagcggctctcatcatttga

SEQ ID NO: 2073 - DNA, 1227 bp, Unknown
  Description of Unknown: Proteobacteria bacterium sequence
atgcgtcgtgtggttgttaccggattgggcatggttagcccaatcggcaacacggtcgaagaaagttggaataacgcccttgccggcaagtccggcatcggcgttattacgcaatttgatgcatcctctttcggcagccgtattgccggtgaagttaaaaattttgaagtcgaaaaatatcttccggcaaaagaagctcgccgtttcgaccgttttattcaattaggtattgctgcagctgtccaggcactggatgacagcggcctgacttttgaaggtgaggaggctgagagagcaggtagcgcgatcggcagcggaatcggcggtttgccgattatctgccagaattatcagtcttatatggaaagaggcgaacgccgcatctctccgttcctgattcccggcgcgattgccaacatggtctccggacagctctccatcatgcgcaatttgcagggtccgtccctggcttactccacagcctgcacaaccggcctgcacagcatcggtgaagcggcctggatgattcgccgcggagacgccgacgtcatggttgccggcggtgctgaaagcacggtttgcccgttgggcgtaggcggctttgacaatatgcatgccttgtcccgcagaaacgacgatccggcaacggcatcccgtccgttcgataaggatcgtgacggttttgtgctcggcgaaggatccggtgttctggtccttgaagactatgaacacgccaagaagcgcggcgccaagatttatgccgagatcgtcggctacggtctttctgccgatgctcatcacattacgacaccgagtgccgaaggtccgatgcgctgcatgaagaatgccatgcgccaggccggactgaatccgtcggatattcagtacctgaatgctcacggtaccagcacgtctgtcggtgacgtcaatgaaaccaatgccatcaaactggctttcggtgaagatgctaagaagttagtagtcaactctactaagtctatgaccggtcacctcttaggcggcgccggcggtatcgaatccgtctttacggttttggcactgaagaatcaagtttctcctcccacgatcaatatcttcaatcaggatccggaatgcgatctggattactgtgcgaatgttgctcgtgagatgccgatccgctatgccatgaagaactccttcggcttcggcggaacgaacggttctctgatcttcggacaggtctaa

SEQ ID NO: 2074 - DNA, 984 bp, Unknown
  Description of Unknown: Proteobacteria bacterium sequence
atgactatcaaaattactagacgttctgtctgtacccttggagcagcagctttaggctgcgcagcattcccttctttcgccgctgaagatccgatccgtattattgtcccctatcctcccggaggtcctttggacgtcacagcccgtgccgtcgctgaagaagcccgtcatgacctgggcaatatcattgttgaaaacaagccgggtgccggcggcaacatcggtgtggactacgttgcaaaacaggctccggacggcaagacaatcgtcatgggcgccttagcaacgcacgctgtgaaccccaaccttttcagcaaactgccctacgatccaatcaaggacttcactccgattacgctgatcgctcagacaccgaacgtactggtcattacacctgaattctcccagaaaaccggcatcaagactgttaaagatttgatcgcgtacgccaagaagaacccggatgctattaactatgcctccggcggcaacggttccgcaggtcatatgtcaggcgagcttttaaagaacgccaccggcatcaagatcgtccacattccgtttaagggcgcagcggctgctcaaatgagcgtactgagcggcgacactcagatgatttttgacaaccttgcttctgcgagcgccaacatcaaagccggcaagttaattccgctcgccgtgacaacaacgttccgtgctccctctctgccaaacgttccgacaatggctgaagccggtgttcccggatttgatatttctacttggtacgccttcttcggaccggccaagatggacccgaaagtcgttgataaactcaaccaagcttttgtcaaagctattaagtccaaacccatggctgaacgcttcgacaagatgggcgccgttgaaaaagccggaactcccgctcagctgaacgactttgtaaaagccgagctcgtcaaatacaaagaaattgtgaagaccagcggagcgaaagtagactaa

SEQ ID NO: 2075 - DNA, 750 bp, Unknown
  Description of Unknown: Proteobacteria bacterium sequence
gtgcttgaacttcaaattaaagatctttgcgtcgctttcaacggcaaggaaatcctccataacattacttttgacattgaaaacggagccttcatcgggattgttggacctagcggagcaggaaaaagcacgcttttaaaacaaatcaacagattggatccgagtaaaacaggcggctcaattctttggcgcggaaaagatgtcgatgattacgacgtccatgaattaagacgtaaccttgcttacgtatttcaaaaagccgttatgtttgacgggacgactgaagagaacatcaagctttcattgaagtatggaaatgaatttaaaccggaagaaattgaagcgctttatcaaactgttttagaagaggcgagtatttcgcaagatattctcgataccccggcacaggatttgtccggcggccagcagcagcgtgtcggtattgcccgtgtattgctcatgggatctcctgttttacttcttgatgagccgaccgcatctttggacgtcgagacaagtaataagttctgccaaaccttaaaacagctgaagggcggtccggcagcaaaagacggaaaaaaacggactttcctgatgattacccatcgactcgaagaagccaaattcttagcagacaaaattttgatgattgaatccgggcatgtagtggaatatacagactgtgagacattttttacgcatcctcagacgcagcgcgccgcagactttttgaaagctcagaatttgtag

SEQ ID NO: 2076 - DNA, 1248 bp, Unknown
  Description of Unknown: Firmicutes sequence
atggctgttatcaatcgctgcttctatcccggcgaactgcttctgccccgggagggcgtgaacctgaccgcatgggcctgcgtggcctgcgaccagttcacctctcagcccgcctattgggaggaggtggagcggctggtgggcgatcagccttccgcgttccgcatgatcctgccggagtgctggctgaacgagaccgacgcacgggttcccgccatctgccgcaccatggaacagtacctgcaggacggcacgctggttcccgccgtggaacggggctttatcctgacggagcgcatcacgccctccggcgcgcgggtagggctggtgggcgtgatcgatctggagtgctatgacttccatcccgaagcgaaaagtctggtgcgggccagcgagggcaccattgccgagcggattccgccccgggtgcgcattcgggaaaaagcgccgctggaaacgtctcatgtgatgctgctgatggacgatcccatgcagtcggtggtagaaccgctgttccagaagcgccgccagctgcgcaagctctacgatttcccgctgatgatgaacggcggccagctgatcggctacgccgtggaggacgcggcggacatcgacgcggtttatacggcgctggaacggctgcgtcagggcgacgaccccatgctgttcgccgtgggcgacggcaatcacagccttgcgacggccaaggccatctgggaaaagatcaagcccggcctgactccggaggaaaccatgacccatcccgcccggttcgccatggtggagatcgaaaatctttacgatgacgcgctgcgctttgaaccgatccaccgggtgctgttcggcgtggacggcgacgacctgctggacgaactgcaggcctatgcggctaagctgggcgaggatctgatcgacccggacgccacacaggacattcacgtggtctacgagggcaaggaagtgacggtttccattcccacgccccaccggctggccgtcggcgatttgcagaccttcttggatgaatggctgcccgcccatcccggcgcaaagctggactatgtgcatggggaaaaggccgttcgggagctggtcaaaggcgagggagccgtgggcttcctgctgcccgcgccggataagagccggttcttcgagcaggttcgggagctgggggttctcccccggaaaacgttctccatgggcgaagccaacgaaaagcggtattatatggaatgccggaagaagtaa

SEQ ID NO: 2077 - DNA, 630 bp, Unknown
  Description of Unknown: Firmicutes sequence
tttttcctgctgctgggtgtgtttgtgaccctgtttcccttcctgtggatgattctgacgtcgttcaagaccgacgtggaatgcgtgcaggtgccgcccacctttctgccgcagaactggacgtttgccggttatgagcgcgtgtggtcccggaacattctggtggcctataagaacacgatcattgtggcggtgagcattgtcttcttccagctgctgacggcttccatggcagcctattcgctggcccgtctgaatttccccggcaagaagctgattttcggcttgattctgtgcatgatgatggtgccgcagaatatgacgctgattccgaagtacaaaatcgtcagtgcccttggcttcaacgacagtctgctgggcgtggtgattcccaactttatcagtatctccgtcacgttcttcattcggcagaatttcatgagcttcccgggagaattggaagacgcggccaagatcgacggctgctcccggctgaagattttcacccggatgctgatcccgctgtccggttccatcctgaccgctatgggcgtgatggtgcttctgtgggcgtggaacgacctgctgtggcctacgatcatcatcactagcgaaaagtaccgcgtgctg

SEQ ID NO: 2078 - DNA, 1248 bp, Unknown
  Description of Unknown: Firmicutes sequence
atgagcatgtatcaggaagccaaagaacgctacgccgcgtggggcgtagacgccgattccgctattgccagattgaaggagattcctgtctcgattcattgctggcagggggatgacgtgaccgggctggaaaacgccggagaagccctttccggcggcattcaggccaccggaaactatcccggcaaggcccgcaccttcgaagagctgaccgccgattttaacaaggcctgcagcctgattccgggcaagaaacggctgaatctgcacgccagctacgccgtcatgacggaggaaaaccgggcggagcgggatgaactcaggccggagcatttcaaggcgtgggtggactacgcgaaacagcgcggccttggccttgatttcaatcccaccttcttcagccatcccatggtgaaggacggcatgaccctgtccagccccgatgaaaccgtgcgtcagttctggatccgccacggcatcgcctgccgccggatcgccgcctattttgccaaggagctgaacacccactgcctgtgcaacgtgtggattcccgacggcctgaaggatgtgcctgccgaccggctgtctccccgtctgcgcctgaaggacagcctcgaccagatttttgccgaaaagctgcccggggtcatcgacagcgtggaaagcaaggtattcggcatcggtctggaagcttataccgtgggcagcaacgagttttataccgcttatgcggcgcagcatcccggcgtgtacaacctgctggacaacggccattaccatccgcaggaattcgtcagcgataagattcccgccatgctgtgctatttcgacaagctgccgctgcacattacccggcccatgcgctgggacagcgaccatgtggtgcggtttgaagacgaaatccgtgagatcgccacggagatcgtccgctgcaacgcgacggaacgggtgctgatcgggctggatttcttcgatgcttccatcaaccgggtcgcggcgtgggtcatcggctcccgcaatgtggaaaaggcgctgctgtgggcgctgctcatgcctcacgagcagtggaaaaaatggcagggcgaagcgcggttcaccgagcttctcatggcacaggaggagttcaagaccctgcccttcggcgcggtgtgggaggaatactgccgtcagtgcggcgtgccggaaacgaagcagtggttccaaaccgtcgaaaaatatgaagcggatgtgctgaaaggaagaaattga

SEQ ID NO: 2079 - DNA, 555 bp, Unknown
  Description of Unknown: Firmicutes sequence
atgctggacggcaccattccgcaggaggaatatccgcgttatttacagatcgttttcgacgaaaccaatcggatgaaacggctgatcgccgatcttttgcagctgagccgcatggacaacggcgtagaaaagctgcaatggtcggattttgacatcaacgaattgatccgccgccttctgatcggtagaatgaacgatattgaacagaaggcgctggatttacagctggacttcgagacggatccctgcatggttcacgccgacagcgaccggatttctcaggtggtattgaatattgttgataatgcattgaaatatatttctcaaaatgggcacttgacaattcgtaccaaaatgatgcaaaataatattgttgccgtggagattgaaaatgacggagaacccattgccgcaaaagatcgggtgcatgtcttcgagcgcttttatatggctgagaaagcccatacagcaggaaagggaacaggtcttggactgagcatctgcaaacaaattatggaaatgcacggtcaaagtattgaagtccttcttctggat

SEQ ID NO: 2080 - DNA, 678 bp, Unknown
  Description of Unknown: Firmicutes sequence
ctgcgctccacctctccccgggtgaacctgaaccgttcctgctgcgtgcgggcgtttctgcggggcgccatgctgggcggcggcaccatgaccaacccggaacagggctatcatctggagctgggctaccgggacgagaccttccgggactgcgcggccaagtgcctgcagcgggtgggcctgcccattcaccagtcctcccgaaagggaaaggattttctgtatctgaagcagtccgaccagatcgtcacctttctgaccgccgtgggcgcgcatcaggcggtgatggagatggaaaatctgcgcgtgcagcggcaggtgctcggctcggtgaaccgggccatgaactgcgacagcgccaacctgcaaaagcagatgaacgccagcggcgaacagcttcgggccatcgaacggctggcgaaacgggacgggctgaagggcctgcccaaagcgctgcaggagatcgccattgcccgcctcaacgccccggatctgacgctggagcagctggggcagacgctggatccgccccttggcaaaagcggcgtcaaccaccgcatgcgccgcctgatggaatacgctgccgaattgccggaaaccccggaaacatcaaaagaaacccaaaataacacgccgcctgacagaaacaagcggccggaaacgaggaaatccccatga

SEQ ID NO: 2081 - DNA, 756 bp, Unknown
  Description of Unknown: Firmicutes sequence
ctttcccaactcggcagttccatgaccgcctatgccctgacgctgtggctctacgaaaagaccgggtcttctttgagcgcggcggcgctgacgatctgctcttatgccccctatattctgatgagcatatttgccggggctttgacagaccggtttgacaaaaagaagctcatgctctgctgcgacagctttgcggcggtgtgtacggtaacggttctggtcttgttctgcatggggcggcttgcgggatggcatctgtatcttctcaacgccgtttcggggctcatgaacacggtacagcagcctgcctccgatgttgccatgactctgctcattccccgggaacagtaccagcgggcaagcggtctgcaatccctgtcaaggtcgctcatttcgattctgaatccgctgattgccacggcagtgtattcctttgccggtctgaaactggtgattgcccttgatctcgggagctttgccgttgcctttctggcattgcttctactgattccaattccccaaaatgaggtgcagaaggaagaaagcgttttatcgcttgccaaaggcggactgtcctttctgaagcagaatcccatgattctaacgctgattctgtttatggcaggcgtgaaccttgtagcatccgcctttgacgcgacgctgcccggtttcgttctgcccaacccgaagggcggcgcacggatcttgagccttgtgacctcctgttcgggcatcgccatgattttcggcagtctg

SEQ ID NO: 2082 - DNA, 903 bp, Unknown
  Description of Unknown: Firmicutes sequence
atgattcaggcggggatgaacgttgcgcgcctgaacttttctcatggcacttacgaggggcatgcccaaaacatccgccgcattcgagcgctgagcgccgaactgcatacgcctgtcggtatcatgctggataccaaagggcccgagatccggctgaaaacctttcgggaccatcgggtgacgctgcaaaaagggcagctctttaccctgtgcaccggcgatgtggaaggcgacgccgagcacgtttccattacctatgcagatttgcccgccgatgtgcagcccggaacgacaatcctgatcgatgacggtctggtcggcctgacggtggaagcggtcagcaaaacggaaatccagtgccgcgtgaataacgggggcgtgatctccgaccgcaagggaatcaacgtgccggatgccaatctgagcatgccctttatcagccgaaaggatcgggaggatattctcttcgggattcaggagaatgtggacttcatcgccgcttcctttacccgcacggaagaagacatccttgccatccgcaagctgctgaccgacaacggcggcaagggtatctccatcatcgccaagatcgagaacatgcagggcgttcagaatatcgacagcattctggccgtcagcgacggcgtgatggtagcccgcggcgatctgggcgtggagattcctttggagcagattcccattattcagaaaatgatcatccgcaaggcttactcccggggaaagcagatcatcaccgccacgcagatgctggacagcatgatcaaaaatccgcggccgacccgggccgaggctaccgacgtggccaatgccatttatgacggaacaggcgcgattatgctttccggcgaaacggcggcgggcctgtatcccgtggaggcagtg

SEQ ID NO: 2083 - DNA, 858 bp, Unknown
  Description of Unknown: Firmicutes sequence
ctgccgaacacccgcgccgtggattttgggcggcgtttcgtctgttttctccttttcagcgtccttcccatcctgctcagcttcggcgcctatcttctcgtgatcgcccttaatggtctgggagcctatcttctctgggaaaagctgctggcccgcatggccgtccttcttctgatccatttctatggctttgccgtcggagcgctggcctgtgtcctgaccggctatttctgggcggctctgctggccggagccgtgctcaccgtttcctttgagggaacctttttcctgtggagcaccattgccggtcactatctggataccatgccggactccttctatcaggactggctcagccgcctgtcccccatctatgggatgtacaaaaacgtttatcagcccggcattgtttctctcctgccggggcttgccgccatcttcctgatgggcggactggccctgctgctgtatcgcatccgtcgtctggaatccgccgagcatacgctggcctttcatccgctggaatggatcatggagctttttctggggctggtcggcggcacgcttacgggcgcgttggtctggtacaccgccgggacggagctttccctgctgctggggctgtttctgggaaccctgctggtctccgggctctgttatctggtttttcacctgcgtctgaccggcattttccagcgctggtatctgcccgtctgcacctccgtggtgctgcttctggccgtggtctgccttcactatgacgtcttcggctacgaccgctggcttccctcccgggaaagcctcacttccttcacttttcgtcccaatctttccagcgcttcccaggccgtcacgctg

SEQ ID NO: 2084 - DNA, 1077 bp, Unknown
  Description of Unknown: Firmicutes sequence
atgacctcagctttccaatgcgaaaccctgaagggaggaattttcatgaacggaaaacagatcgtttttaccgccgccaaccgtgcggaactgctggatgtggagctgccggaggtcggcgagcatcaggtcatggtgcagacggtgatctctaccatcagcgcggggacggagcgcgccaatctcaccggcgaccccaacgtcgatcctaacggagcgtctcgggtgtcgttcccgcgcagctccggctacaacagcgccggaatcgtcgtgcgcacgggcagcgccgtgaccggcgtgaagcccggcgaccgagtggtggtctactggggcaaacatcagaactataacgtggtgccggaagagcaggtcatcccattggacggcgaaggtctgccccattccctttcctttgaaacgggagcgctcagctttattacgaccttccccatggcagccatccgcaagacgcggctggaaatgggcgaaagcgcccttgtgatggggctgggcgtactgggactgattgccgtcaagctgctgcgggccgcaggggccgtgccgataatcgccgcagaccccaacccccgtcggcgggaactggccctgaaatacggcgcggatgatgccttcgatcccctgcaggaggattttgcccggcaggtgaaagacgcaacgcacggcggcgtgaacacggcgattgaggtcacgggcgtcggcgcgggcttcaacgaggcgctggactgcatggcgaagttcggacgggtggcgctgctgggctgcacccgaaacgccgatttcacggtagactattacaagaaaatccatggcccgggcatcaccgtcattggcgcgcacaccatcgcccggccgaacgtggagtctcatccgggctggttcacccatcgggacgatattcaggcggcgcttcggctgtgcgcgggcgggcggctgaacttggaagagatggtggaagaaacccattctcccgaggagtgcgcggcggtttacgagcgtctggcctttgaccggaatttcccgattgcggttcagtttgactggaggaaaatgaaatga

SEQ ID NO: 2085 - DNA, 720 bp, Unknown
  Description of Unknown: Firmicutes sequence
tatatgatgggggaaacctgcatttatttcccctgctccatgttctgccgggagcgttatcaaagtggaagcttcggtcggtttgtgtatggcgaatcccagtactatcacgatatttctcatttcccggctacgtttttggaggataagaccagcgcgggcgttccgcctttcttctatcccacccattccaccgccatgctgctgcatgccgtggacagctatgtgaccaaggtgactgccatggggtatgtggatcaggagcatgacggcatttacgaaaaaggaatcaatcagtgggataatgtgatttccaatggctattcgctgatgcagctgaaaaacggcggcgtaggacgaatcaacgaatgccgccggattggccacaaggcgccttcttcctgcatttccgggttttacggcaccaaggccggctatcagttcagcaacgcccagcatttggtgacgaaaatgctgccggacggcgtagagctggaagaagtcagcgattatgtgaacccggaagaaatgacgaagcaccgcggcgagcctgacttcaaaaatcgggtggcgaatcacggctggcagtgggatgatttcgcgccggtacaggcgaaggaacgggcccgtttgccggaaagctataaaaatctgcccaacggccatatggcgtcccatcagatgctgatcgacgacttctgcacggctacttatttcggc

SEQ ID NO: 2086 - DNA, 894 bp, Unknown
  Description of Unknown: Firmicutes sequence
atgtacgtcagctacgaccgctatcgaatcttttattatgtggccaaatacggcaacatttcacaggccgccaaggtgctgctgagcaatcagcccaatttgacccgtatcatcaaaaatctggaaggggagctgggctgcaccctgtttgcccgcaccagccggggcatgaaactgaccccggagggccagcgcctatacgaccacgtgcgaatcgccgtggagcatatcgaagcgggagaagcagagatcaacgaaaaccgcagtctgcacagaggcaccatttttgtcgccgccagcgaagtggcgctccgctgcctgctgctgccggtgctgaaaaaataccggacgctttatccgggcgttcatatccgcatcagcaaccattccacgcctcaggccatcgcggctctgaaggacggcacggcggatattgccgtcgtcacaacgccgacggcccactcagcctcgctggtggaaaccaaagtgaaaacgatcacggaggtggccttttgttcccccttcttttccgcgctgaccaaccgcccggtttcgctggaggagctgctgacctacccgctgatctcgctggggacggatacgaaatccttcgagttttattccgaaatttttaccagccacggtctgccctatcagccggacatcgaggcctttaccgccgatcagattctgcccatggtggaggcggatctgggcgtgggcttcgttccccgggattttctgcgggaggacagcgccgtatgccagattgccctcaaagaaaaaatcccggagcgaagcgtggtgctgatccaacgaaaagagcagccgctgagcgtggctgcccgggaactgaaacggatgattctggaaggggaaacgactgggaaatga

SEQ ID NO: 2087 - DNA, 1065 bp, Unknown
  Description of Unknown: Firmicutes sequence
atgagacggacactgcttcgcggctcggcgctgctgctgggcgggattcttttgggaatgcttctgctggcggcggcgtatgccctgccggtggagccaatcagaaagcatctggaggaatcgcttgtctgttttgacggcagcgacgatatgccggaggcggacaacgaaacgctgatcaaaacctatccgggcacatggctggacgttcgcacggatctggtgatgatgcagatcgccgcctacgattccgatgtttctccgtgggagcaagcgctggaaaaccgtatgtataacgatatggagcactatttccggctgagcgatcgtttggccgcagtcgcccgaggagtcggcaaggatgcggagcccgcctattcctatggccgctactggcatggatatctggtgctgctcaagcctctgctgatgctgtgcagctacatggatattcgaatgctgaacgttctggcgcaggggacgctgctgctgtatttgatcgtacagctgaaaaagaagggcgcacgctgcatcccggctttgggggcggcgctggctgtattgcaggcatggctgcttccgctgtgcctgcaatactcgacggcatggctgacggcgctggccgctatgtgcctgctgatcaggttccagcacggctttgagaaaaacggcgctgcgctgttttttctcggcataggcatggtaacggcttatgtggattttctgacctatccgctgattaccttcggtctgccctgcgttctctggctgatgctggaacaggaccggcaaaagaatgcgttttcgctgctgctgcgtctggcgctggcatgggggattggctacgctggaatgtgggccggaaaatggctgatgattctgctcttcgggcaggcaggggaaggcagcatgattctcgccgccatggaagaaagaggactgaacggcgccatcagcccgtggagcgcgattcttcggaacgtgagcgtgctgtggcgcaaaccctataagcttgcgctggcatgcgctgcggtctggatggcgcttctgctgattcgtctggga

SEQ ID NO: 2088 - DNA, 1089 bp, Unknown
  Description of Unknown: Firmicutes sequence
atgagccgaaagcaggagcttgccatgcagacaaagcggttggattatctggattttatcaaggcggtcgccatttgtatggtggtgttctgccatcgggtagtgatcccggacgacagcgtggcgggagccgtctgcatggtgctggtcttttcggctgttccctgctttatgatgtgcagcggctatgtgctgctgtttaagcaggaaagcgccgggaagagctttcgccgggccgggcatgtctatctttgcatggtggtctggaaggcgctgtattttttctttttccagatgtttgacacggtggaatggaacgccgtcaccctgtttcggtatctttttctgttctgctcgcttccgggcgtggatacggagaatctttggtttttgcaggcctacatccccgcgttgctggtaacgcctctgctggcgcccatgttcacccagcggaagttcggcatggcccttgcctatacgggtctggcctacctgtccaatcagttcgttatgagcgccaacctgctgctgcaggtgggttcgtcccggctgcatgtggagctgttcgacgtggaaatgctctcccatgtgttcccgctgggcggagaatactcctccatgctggtctgctttctgctgggcggcgtgtaccggctgctggaagagcggaaccttccgcaaaaacgttcgttccgggtggcggcgtttttcggcatgacgctggggctggccattatgatgggggtgcggtatctgcaaatgggcagctttgcctggaagagccttccgctggtcgcaaagtacgaatggtccggtacgcttttgacgagcttttgcgtgttcgcgctgctgcggcccatgggcgacggaaagctggcccggtggctggggcgccatgtggggcagtgtagcatgggcgtgtactacctccattatctgtgcctgatcccgctgagcatttatgtgtaccccctgctgccggtatccctttgggtgaattttgcgaagacggcgctggtggtagcgttctgcgttctattgaccaaagccggaaaacggattccgctggtgcgggagctgatgcgctga

SEQ ID NO: 2089 - DNA, 1413 bp, Unknown
  Description of Unknown: Firmicutes sequence
atgttccgtcaagccgtccgccgcgccttcgccctgctgctggccatttgtcttctgcccgcagcagcgctgggcgaggcagtatcccccgccgaagaatggcctgtggattccagcgccgttacccgcgccgattttgacctgagcgttcagctccacgcggacgcctttccggctgacggtctgacggattatcagggctgggagacccttctgagcaagctgcgcctttccggcgtgatggatctgcagcggtttccccggcccaacaaccgtatgtacatggatgctcagatttttctgaacgatcgggagctgacaagcttttcctttgaggattactggggcttccgctatttgcgcagccctgcgctgtgcaatcggagcattcatttccagatggacaactatctggaattcatgctcaagccctatgaatactacgagcttcctacgcagtacatcgcgctgctgacctatcccgaggtcacggcctatctggcggaaagctacgaggacgtgctgacgccgtatttccacggggaaggaaaccgcacgatttcctatgacgatctgtatcagctctgtctggacatggacgccgtgatgacggaagcgaaggcggaacagtcctacttctacctgtctgccctgctgatcgatctgggcatgaccgagcaggtctacgacggattgagctatctggaagattatctggactggctggatcccgagcagcagggcatgaccatcacggcaaccggcaatacggatcgctatgaaatcggcggccataccctgttcacccgcacccgggacgaggacacgctggccttccggctgtctttgcccacggaaaacgacgaagagctggctgtggaatacgacagaatgcccggcgtgaacggcggcacgaacgtcaatgcccggctgaccgtttccgtcgaagaagaaacgctgatcgacctgacgctgaccgccgacggactcccgaaggaaacggatacgcaggccatcggccatctgaccttcgcggtttccggcagcgccttggaagaggcagcctatgcgttccagttccggctgacccgttccgccgaagtgccgcccttccatgtgaccttcggcgtggactggctccatcccgaaaccgaaaaaccggcctttacccttctctacagcgccgatgtggaaatgaaggacgaaagcgtactggtggatcgaacctacaacaatcaaaacgatttcttccatctgaacgatgcctatctggaagaatacaagagagattttgcgcttccggtggcgcttacctgcgcgccgctgctgatggaaatgccgtccggcgttctcaatgacattctgcgtttctgcgatgaaaccggaattttggccaccctggggattgaatag

SEQ ID NO: 2090 - DNA, 750 bp, Unknown
  Description of Unknown: Firmicutes sequence
atgaatctggatcgtgtgattgcggttcgaaccaacgaaacggtctaccgggacggaatgcagtgtgtcaaagtgttcggcgacggcttcaccaaggccgacgcattgggcgaggcactgaaccaggcccgcgtggaggaatgcggcctgcacgttcccaaggtgctggaagtcagccaggtggacggaaagtgggcgcttgtcaccgaatatatacagggcaagacgctggaacggctcattgcggaggagccggagcagaaggaagccctgctggaacggatggcagacctgcaggtggaaatgatctccaaaacctgcccgctgctcagccgcctgcgggaggaattggaaagccggatcgctcaggcggagcttcccgccacgacccgctgcgatctgttcttccggctgcaggagattccggcggaataccagatctgccacggcgacttcaatccttccaatattgttctgacccgggaagacgaactctatctgctggattggagccatgcttctcagggcaacgcggcggcggacgccgccaacgcatggctgtggtttcagctggccggagacgcgcagggcgcgggacggtatctggaatgcttcagccaaaagaccggcattgacccggcgatgatacagaagtggatccccattgtggccgccgcccattcagcagagagcggagaaagggaacgcactttccttttgaaactggtcaacggtgaggattacgaataa

SEQ ID NO: 2091 - DNA, 561 bp, Unknown
  Description of Unknown: Firmicutes sequence
atgccgaaaatcttcaaaattctggataaattcaaaatcgtctatgacgtcacggataagatcctcatgacgatctgcaagctgcttctgatcgccgatattctcatcgccacgctgaccgtgatccagcgctatgtgcccaacgcgattttcccgcccatgccctggggcgagcagatggtgctgacctttatggtatacatggccgtgctttccgccgccttagccattcgccgcggctcccatatccgcatgacggcctttgataagtattttcccaagacgctggtcaagatttcggacctcatcagcgacctgatcgttcttctgctgggcgttatcatggtggtttacggtgcgcaggtctgcaccggcccgctggcccgctttgccaagtacgaatccattcctaccctgagcaaaatgtggatgtatctgcccgtgcccatcgcaggcgccggtatgattgtctttgaattggaagccatttatcagaatcttcggtcgttcttcgtcaaggaagaaaaagcggtcgtttcagaggaggttcaggcgctatga

SEQ ID NO: 2092 - DNA, 903 bp, Unknown
  Description of Unknown: Firmicutes sequence
gaaagcgccgttgagacgctgaccctgcagagcgggggagaggtttccacgctggtgggcgtagctacgggcgcaaaaattcgcggcacggtgtttcaggatgcggattataacggccagctggacaaaaaggaaaggcgcatttccggcgtacaggtgcaggccgtggatgaaaacggcgccatcgcggcgacaaccacgaccaatgccgacggcaagtacgcgctggacagcctgatgcccggaacctacacggtagcctttaagcgggtctccggcatgggctttacctgcctgcgcccggagctggacggcggaagctgggtggtggagctgctggatggcttcggtcaaacggaacccatggaagtgaccatgggagcgttgatcgacggcattaacgccggtatgctgcctgcttccacggtgactggacagcttttccatgatgcgaacgacaacggcctgtgggacgatggggaaaccggcatgaccggcgcgacggtacggctcttgtccgaggacggggaaaccgactggacgcgcacagtggacgaaaacggcaatttcctgtttgacggcgtaatgcccggcaactatcaggttacttatcagctgccggagcataccgtcatggcgcgcacggcggagaacggcaatactcaaagcgaaacggaaacggcttcgttcaaggtagaaatgggaacggaaagtcagcttccgctggcaggagcggtggagctgggcagtctgagcggcgtgattacggcggacgccaatggtcagcccttggcaggtgcgacggtgacgctgacgcctgaccgggcctccgcagaggaagcaacggtgcagaccggcgcggacggaagcttccaactggaaaatctccggcccgctcagtac

SEQ ID NO: 2093 - DNA, 1461 bp, Unknown
  Description of Unknown: Firmicutes sequence
cattcctccacggcccagtgcgtctatatttttctggcaggcacggcggtattgtgcctgctgctgatgctggcggttacgccccagcgctataatctgaaggtgggggacatcgcccccaacaccattacggcatccaaggacgtagtggacgagatttccacagcccggcagcaggaagccgccgctgccgccgtggaacccacttacgtctataaggaaggcatttccgccgaggtgatgcagaacctgcagtcggtgctggcgcaggccacggctgtgcagaagtacggccagcgggtgctggaaaccgctgcccccgacgaccggcagaagcagaaaagctatcagttttccgaaacggagctgaagtacgcccgaacgctgctgacccagctgacgctggcggattatcagctggacactcttctccgggccacggaggagcagatgacggaaatgtgctccaacctgaccgctgcggtggaaaacaccatgaataccaccgtccgggagacgaatgtcaacgaatccatccagtatttgcagcagattatcggcctgaagaccgacatcgaccttttgcagaacgtggttatgcccatcctgcgcaaggtggtgcagcctaacatggtcatcgatcaggaggccaccgacaagctgcgccaggaagcccgggacgcggtggagcccgtggtgtacaagcaggggcagaacatcgtgctggcccgggagcgggtgacggccaaccagctggaaatgctgcgttcgctgggcatgctggacaacgacaccttcgacctgaacatttatatcggcgcgtttttgctggtcatgctgagcatgatggtgctgcttatcgctttgatcctgctggatccggagctgctggcctcgccgaagaagctggtgctggtcatgctggtgctgtgcctgaccatgggcgcgtgcgtgctggccaaggagattaacccctatctgaccccggctttgctgggcgtgatgatgctcaccggcctgatcggggcccgggcgggcgtggcaggctgtctgactttgacggtgctggtcagcgcccttctggcgggcggcgataccagctatacctcggaaatcgtgaacctgctgtttatttcctttatttcgggatttctcgtggtcattgttctccggcggaagccctaccgccagcaggtgctgctgtgcggcctgctgaccggcctttccaatatggtgatcattctgaccatcggctttatgaccaacaattccatgggcgttgtggtcagcaatgccctgtggagcgccctgtccgccgtggtggcgtcggttctgtgcatcgcgctggacgcgctgatggaagccgtcttccggctggcgaccccggccaagctgctggagctgtccaatcccaatcagcccattctgcgccggctgatgatcgaggcctccggcacctat

SEQ ID NO: 2094 - DNA, 687 bp, Unknown
  Description of Unknown: Firmicutes sequence
gtgacgtggtgggaaatttcccttcgtcttcttctggccgtcactgtcggctgtgtgattggcattgagcgggaacgcaaaaaccgtcctgcaggtatgcgcacccatgtgctggtttgcgtgggcgctgcaacgatcgccctgatcgagtgcatgaatatcgccgataccatcaccctgaatatgaataatcccaacaccggtatcgcggtcagctatgggcgtatcagtgctcaggtcatcagcggcatcggttttttgggcgcaggcaccattttcatcagccaaaagaagatcgccggtctgacgacggcggcttcgctgtggaatgccgcctgtctgggcttggcgattggcatgggctattatttcatcgccatcgtcggatgcgggcttgtgatggtgacgctggttcttctgcagcgtgtggtgaaggtcaattccgtcaagcatgtagaggtcaaattcattcaccgggtggagaccatcgcctttatcaacgattactttcagtccatcggcgttcgtgtgctggatattgacttccacgtggagaataaaggcaagtataacctctataccaacatttatacgctggatatgcagggaaaggcgacctacaaagacatcgtgaacaagctttccgagcacaccaacattcagggcattcggacgcggaacacctga

SEQ ID NO: 2095 - DNA, 726 bp, Unknown
  Description of Unknown: Firmicutes sequence
gacggttccttcttcaatatgctggtcgcctccggcgaatatccggatattttcattgcggcggatgagctgggtcgggattatcccggtcagaccgacggcgcgatcgaggatggcatcgtcatcaaccctaacgagctggtcgaaaagtacgcgcccgattatctggcgatgtacaactcgctttccgataaggataagctggtcctgaagaccgacagcggcgtgtacaagctgaccggcctgggcagcaacgtggtcaacggcatccagcacaccggcctgcagatccgcaaggactggctggacgcgctgggtctggaggttcccaagacctatgaggacttcgaaaaagccatgctggccatcaaggaagcctatgatgtgaccgttccgctggccttcgctcagttcgacgattatttcatcaacaacagcaacgtgctggccgccggctacggcgtcacctgggacggcttcatcctgaacgatgaaggcaaggtcactcactcctatctgcaggccggctatcgtgatttcctggaaatgatgacacgctggatgagcgaaggcatcatcgacgtggataacatcaaccgcacgcatgacgactgcaagaagatgtactacaccggccgcaccgccgtcatcggcatcggcaactgggagacccgtaccctcattcagaccggccccaccgaggatcccaatttccactccgttccc

SEQ ID NO: 2096 - DNA, 783 bp, Unknown
  Description of Unknown: Firmicutes sequence
ttgaacgagctgcacgccggaattctctgcaccgtgatgacgctcagcctgtgcgccgcacttcatagctgtctgtgcgccttttattacaaaatgccccgtgcccgcgttctatgtccaatgctgctgattgtctgcttcctgccgctgagcctgctgctttcccgcctgccggagacttccgcactgaacggaggcttatggacggcggtcacagtgctgcttttcttcctgagcggcgcggtgctgatgctgctgctgcgctggattgaccgccacgtctcgcaaatctccatcaaggaaagctgcgaccggctgcccgccgcgctgtgctttgccgctgaaaacggcagaccgcgcctgatgaatctcaggatggacgagctgagccatgcgctcaccggagaagcgcttctgaacgccaatcgcttctgggcggcaatttccggcgggaacgagcattccatcgtgacgctgccggacggccggacatggagcttcgagcgcacacgaatgaatgggaacggcgaaggcatctatcagatcatcggggtggatgtaaccgccgaggcacagctcaaccggcagttgaacgaagaaaatgcacggctttccgagttgaacgcacggctgaagcagtatagtcaaaacgtcgggacggtcgttcgggagaaggaaatcctgctggcgaaggtgcgcattcacgacgaattgggacgcacgcttctgcgcacacgccgtctgctgacacacggtcaggaagacggagacgccgtccgcgcg

SEQ ID NO: 2097 - DNA, 465 bp, Unknown
  Description of Unknown: Firmicutes sequence
gtgatgcagcgcaacgatcccatggcccgggagatcgcccggcggtatttgcaggcctcttttgactacatcaccgacggggcgggcggcatgatcctgctgcatcccgggctggccaacccctatcagctggtcaaacgccagcaggtgggcgcgctggacacctttgaaatgagtcagcagatggtggcagggggcatgaacggcatcctgccggaggaagttcccctgcacgaagccatgtgtgccgccctgcggggcgcgctgcggccggagctggacgtgaacgacattgcggaagacctgcgcatgctggccaagcagaacgcctccctttctgaaatggagagcgtgctggcggaatcggtcacagtgctgcctacccgggaaatgcgggatgcggtgcgcaggctgtacgaaggaacgccgcgctggctgggcctgaaagcggcgctggagcattaa

SEQ ID NO: 2098 - DNA, 1170 bp, Unknown
  Description of Unknown: Firmicutes sequence
atgccggagctgccctttttcccattgacgcctaccatcaaggtctttccggacgagcctgtccgggaggaatggaggcgcagtcagttcgagggctttcagaatgaaaccatttcctttcaggccgccttttgcggtatggcggaatatgaccgccgtccggtggttctgcgcgcggaatcaccgctgaaaaagcagatacggatccgcacggtgctttcggttcccgttaggctggctgcgctgcccggagcggacgataactatctgcgcaaaacccccggactctatcccgatcttctgcgcgaccagcagccggagaatccgctggccattctgcgggtgcagacggagcagtggcagtccttctggatcgatgtggagccggaagacgaatgcgaaccgggcgtctatcccgtggagctgcgtcttgtgacggcagatgacgaaacggttctggcttcagccagcatttccgtgacgatcctgccgggacggcttccggcgcagaaattgattcgaacccactggttccatacggactgtctggcggaatactaccgtgttcccgttttcagtgaggagcattggacgatcattgaaaactttatccgaacggctgtgcgccggggctgcaccacgattctcacgcccctgttcacgccgccgctggataccgcgcccggaggcgagcggctgaccgtccagctggtggatgttaacgtctgcaagggcgcgtataccttcggctttgaccggctggaacgctgggtggagatctgccgccgctgcggggtcgcctatttggaaatgtcccatctgtttacgcagtggggcgcggcagccgcacccaagatcatcgccacggtggacggccaggaaaaacggctgttcggctgggaaacggacgcgcacggcgaagcatacgcccatttcctgagcgagttccttcccgcgctgatggagaagctgaacgagctgggcgttgcggaacgcgcctattttcacatttccgacgagccgtcactggatcatctggaaagctaccgacacgcctgttcgctggttaagccgtacctgcagggacggcctgtgatcgacgctctttccgattttgctttttatcagaccggcgcactggaaaagcccgttgtggcgctcgaccatctg

SEQ ID NO: 2099 - DNA, 732 bp, Unknown
  Description of Unknown: Firmicutes sequence
gagcagctggtatcctgctaccgcgcctccctggcgctggccaaggaacacgaatgcgaaaccgtggcctttccgctcatttcctccggcattttcggctatcccaaggatcaggcgctccgcgtggcggtggacaccatcggcgaatttctgctgcacaacgacatgacggtctatctcgtgattttcgaccgcaatgcctatcagatcagcggcaagctgtttgccgagattgccgagtacatcgacgatcattatgcggatgcgcacaccgactccctgcgggaggatcggcgcaggaaaagcgtcctgcaaagcatgaagcccgtattttacgggagcgtgcaagcgcccacggacaccggcgctctgagcgatctgctgtcgcatctggacgcgggtttttcggagaccttattgcagctcatcgaccgcagcggcaagaaggacgctgagatctacaaaaaagccaatgtagaccgcaagctgttctccaaaattcgcaacagccccggctacaggccctccaagtccacggccattgcctttgccattgcgctggagctggatctggacgaaacacgcgacctgatcgcccgcgcaggctacgccctcagccccagcagcaagttcgatgttatcatcgagtatttcatccggcagaaaaagtatgatatttttgaaatcaacgaggcgctgttcgcctttgatcagagcttgttgggagcgtga

SEQ ID NO: 2100 - DNA, 1104 bp, Unknown
  Description of Unknown: Firmicutes sequence
cgaagtctggaagaggccgggtacggcttcctgacagaccgcctttccgctgcggatgagacaaatgaggtgctggagcacgggaaaaaggtctatatgctgggacgggtctgccgggacaaaggcgtctccccctgctatctgttcgaggagacggcgctttcgtccgacgcgcaggcctttctgggcaatgtgcgctcgtgcctgattccgtggtttgttgtgatcggcattgatattctggtgattctgctggtcgcagggcagttctccaagcggatatccgcgctgattgaagccgtcaatcaggtggcgaaccgaaaatcggattccttccatgttctggagggcagcgacgaattttccaccctgtctcagtatatcaatgagatgattacgaaggtacagtattgtcagaaggaaacctatcaggccaagctggatacgaaaaacgcgcagattcgcgcgctgcgcagtcagatcaatcctcatttcctgttcaactgcctgcagtccatccaggccagcgcgctgaaaaacggcgcgatggaaaccgccgacctgatttccatgtattcccgggtgattcgggaaagcatcagctggaagcaggaggtcatcccgctcggacaagagctggggctgatcgagagctatctgcaaattcagaagaagcgctttgaaaagcagctgatttgcatcattgacgtggaggaagcctgccggaatgcgcagattcccaaattcacccttcagcccattgtggaaaacgcgattcatcacggcatgcagggctgcgggcatccgctggaattgacgattcatatttcccgcgccgaggacgaactgaggctggttgtccgcgataacgggaagggcatgagcggggagcagcttcaggaaattcatcagctgctggagggcgatctgtttacggatccgcaggttcatatcggcattgtcaatttgcagcagcgcatctggctgcgctacggcagggcgtatggcattcggatcgcttcttctccggatgtgggaacggaggtcgatatccgcttgccttttgagattgcggcgggagaggacgcgcagaatcaaacctga

SEQ ID NO: 2101 - DNA, 426 bp, Eubacterium sp.
aaattgaaaaaatcaactgatgaacttctcaatagcttaaaatcaaaaagtaatcttgacgattattttaaagaaaactcggatcagctgaattttgcgacattacctcaaatgcttgaaagtattatacaaagcaaaaagataagcaaatcagaagctataaataattctatgatagaaaagcactacggctatcagatattccaaggaataaagacaccgtcaagtgataagctgataatgctctgcattggaataggtgcggatctgacacagacagaaaaactgctgaaccgtataaaagcgtcgcctctgtatgccaaagacggcagagatgcggtaataatgtttggactgcttcacaaactaagtgtaattgatattaatttaatgctgtatgacagaggctttgatgtacttgaatga

SEQ ID NO: 2102 - DNA, 483 bp, Eubacterium sp.
atgcttaaaattcctgaaaacaaaacaagaaaaagatttagaatagcacaatgtattttttatgcattattagttatgttatgttctatgccgtatattcagggtgcaactacagacggcaaatttttctcttactcggtgcttgaccttatgtcatttatcggcggtactgcagacggtactctcggagatgcatgtttgaattatgtaatgtacactcctattttaattattataccggtaatcggatttttcttttgcctttttgacagagagagaaacataaaaaatatagtatctttactttgttgtgcggcaggcattgtggccatacttgctattgcaggcgttgcaatgagccttggtgccatactttcaattctcatttatcttcttatctcatttttgacaaccattgctatagttgcacgatttacaaaagattcttctgacgacaacaaaaagcagaacataagaaaataa

SEQ ID NO: 2103 - DNA, 462 bp, Eubacterium sp.
atgaaaaaggtagtttctttggtaacaatatttgtactttgtcttactgcgcttgcaggttgttcaggcagcaaagaggttgatttaaaaacagttctttctgacatcaactctaagtattcattggacttaaaagagcttacagattctaatgatcttaaaaaatattacagcatcgacacagaagatgttaagcagtttgcggcagaaatcaattcagacagcaattcaagagttgaaatcgtacttgttgaggctgctgatgctgatgctgcatcaagagtaaacgatgcgctttctaagacatacacttcaatcgttacacagtattcaggctacaatgccgaaaaacttcctatggttgaggcttgtaaggttacacaggacggcaactatgttacaatgattgttgctgaccagggtcctgaaattcttgaaacattctacggctacataaaataa

SEQ ID NO: 2104 - DNA, 408 bp, Eubacterium sp.
tgtatttatgtgataatattgcaaaaaataattatgttttcaacaaaggaggtacttacaacggaaatgttatttaaaaacggtaaaatgaaaaatataagcaaatcacaggtgcttacattaaaagacgaagttgcttatcaggacggaatggtggtgagcaaaacccttgtacaaaacgatgcagtaagcgtaactcttttttcttttgataaaggcgaggaaatcagcactcacgaatcgggtggcgacgcatttgtaacctgccttgacggtgtcggaaaaattactgttgacggcattgagtatatattaaaagaaggcgaatcaatcgttatgcctgcaaaacaccctcacgcagttttcggtgaagaacgctttaaaatgctccttatggttgtattctga

SEQ ID NO: 2105 - DNA, 504 bp, Eubacterium sp.
atgattatggacgaaaataatatttcgggtatgcatatttattattactatgtttgtaaaagaaagctgtggtatttttcaaacggtttggcaatggaaagtgaaaacgaaaatgtcaaaatcggaaaacttatagatgaaaccacttataagcaaaagaaaaaacatattatgatcgacaacacaatcaatattgattttattaccgagcataaacttttacatgaggtaaagaaaagcagaaagatagaggaagcgggtattgctcaacttaaatactatctttattatctgaaaaagcgtggggtagagggaataaaaggcagaattgattatcctttgctaaagcaaagtcttaatgttgaacttagcgaagaagatgaaagagagcttgaaagtgcggcagctgatatagtaaaaattatatcggctgctttgccgccaaaatttaaaagtaaaagaatttgcaaatcatgtgcttactatgatttgtgctgtatttga

SEQ ID NO: 2106 - DNA, 426 bp, Eubacterium sp.
aagcgagggataaatatggtaagagaagttgtaagagatccgatgtttttacagagaaaatcggttgaagcaaatatgtcggatatgccgatagccgttgatttgcttgatactttaaaagcaaattttgagggctgtgtaggtatggccgcaaatatgattggcgtttcaaaaagaattattgcaataagcgataacggaaagtatattcttatgtttaatcctgaaatcgttaaggcttacggtgaatacgaaaccgaagagggctgtctgtcgcttgacggggagcgcaaaacaaagcgttataaaactgtaaccgtaaaatatgccaacgataaattcaaaacggttacacgcactttcacaaattttacggcacagataattcagcacgaaatagaccattgcaacggaattttaatataa

SEQ ID NO: 2107 - DNA, 369 bp, Eubacterium sp.
atgaaaaaggaaaagaaaaaaccgcagattaatcctgaaagtaaagccgaaaatacaactataaaggaaattgaacctaaaaagaaaaaacgaggaagatatgtacttttatatctcgcaattatcggatttgctttttacgcagttatcactatagttaatcaaaatattcagatagccgacaaaagagctgaacttgatgagattaataagcagattaatgtggttgaaatccagaccagatatttggataaagttaaaggctacacaggcgaccagcttaaagaatacattgagaaaatagccaaaaacgaaatgggttatgttagcgaaggcgaaagaattttctataatgtttcgggcgaatag

SEQ ID NO: 2108 - DNA, 558 bp, Eubacterium sp.
atgaaaaaactaaggctttttgtattattcttcttaatggcaataattttttctgcttgccaaagtaatgaagttaaaaaaagtataattacaaattttaatgccgattttacggcaagcaaaggagatttttcggcaggaggaagtataacggcaaatgacggtcaaaccgaacttgtttttaacaaaccgcaaactgttgacgggttaaaaatcggcaacgacggaggcgaaatatccattgaaatagatgacttaacaagtactgcagacgaggcatatttgccaaatgacaatcttttgcaacttatacattgtgttgcaacagagatttgtgacgggagagaaattctttatcaaaaaaataatgaatccgatacatatatactggaaacttcaaagggcaaatgcacatattccgtagataaaaacggatatatattatctgcgcaaataaattctaaaaattttcgtattgatttcagaatcaatacgagcttggttaataaaatgcaaactaaagccttcacaatttttacgcccaaaaatattatatag

SEQ ID NO: 2109 - DNA, 672 bp, Eubacterium sp.
atgttaatttatattgtagaagacgatacagacatcagggagcttgaaacctacgcactgaaaaacagcggttatgaggttaaaagctttggagaaagcaagagcttttttaaagcgtgtgcggaaataaagccgcagcttgttattcttgatgtaatgcttcccgattttgacggattgtctgtacttgaaaaattaagaaaagacaagtctacaaaaaatattccggttattcttgttaccgcaaagtcaagtgagatggataaggtaaaaggacttgatatgggtgccgacgattaccttacaaagccgttctccgtacttgaacttatttcaagagtaagggcgattttaagacgctgtacggtagaagaaaagcccgaaaccgtggaacttggcggaattgttcttgacgattcaaagcatattgtaacttcaaacggagaacagtgcagccttacatacaaggagtacgaattgctcaaatatctgcttaataataaaggtatggcactcacaagagagaacattatcattaatgtttggggttacgatttcgagggagagagccgtacggttgatatgcacattacaactctaagacaaaaactcggagaatgcggcaatcttattaaaaccgtgcgtaatgtaggatacaaggcaggagaatga

SEQ ID NO: 2110 - DNA, 801 bp, Eubacterium sp.
atgtcattgttaagcgttgaaaatatccgtaaaagctacggcaaaactcccgtcctgaaagacatcagcttttcgcttgagaaaggcgaggtgcttgcaattatcggttcttccggttcgggcaaaaccacacttttaagatgccttaattttcttgaaactccgcagaacggcaaaatcagtgtaggggataaggtgctttttgacagcaatgattccggcaaaaacagtgagtcgcaaattcgcaaaaacagactgcatttcggacttgtgtttcagtcttttaatcttttcccacagtacagcgtaattgacaatattatgcttgctccacgccttgcggcaaaagaacagataaagcagacaggcgaatatatgggtgcgaaaaatcataaagacgcacaaaaaattatccgagaaactgcattgaccttgctcgaaaaagtgggactttcggagaagagcgaatcgtatccctgtaacctaagcggcggtcagcaacagcgagttgccattgcaagagcgcttgctcttaatcctgatgttttgtgctttgacgagcctacatcggcacttgaccctgaacttacaggcgaggtgctcaatgttatcagaagtcttaaaacttctgacagtacaatgattgttgttactcatgagattgagtttgcaagagatgttgcagataaaattatctttatggctgacggtgtaattgccgagcaaggtacacccgaacaagtaatcaataatccgcaaaatccgagaacacaggcatttttatcaagattcaatcattaa

SEQ ID NO: 2111 - DNA, 492 bp, Eubacterium sp.
atggaaaaaacagttatttgtccgggcagttttgatccggttacgctgggacatatcgacattatcaagcgtgccgcaaatatgtttgacaaggttatagtcggtgtgtttaccaacgaaaaaaagactccgagcttttctgcggaggagagaatacagtttttaaaggaatcaaccgcaggtatcgagaatgttgaaatagtaagctacagcggcttgcttgctcaatattgcaaagagcgcaaggttgacgcaatagtaaaaggattaagagctgtgtctgactttgaatatgaatttcagcaggcgctcaccaataaaaggcttaatccgcagcttgaaacaatatttctgacagcggagtcggagtcaatgtatttaagttcaagtatggtgcgtacggtagcttctctcggcggtgatataagcaattttgttcccgagatgattcatgacagaattgttgaaagactttataaaaaagaaaagtaa

SEQ ID NO: 2112 - DNA, 486 bp, Eubacterium sp.
atgaaaaaagttgtttccctcgcattggctcttgtgctgatgcttgcagcgtctattccggtatttgccgcaccaagtcctacaggtacatacacttatgtagtagttgttattcctaccacaggcggtagcggtgactatgagttcactacaggcattgatgaggacggtaaccagaatgttcaccttactccaaagccaaagtctggttattcttttgaccattgggtaattgacggtccttacagaagaaccgatcagccgcttacagatggaaatcttgatattataatcacaggtgatattaaggtaactccttattacacaatcaacggtgagtcacctacacaggctgtaacaacagatacttctgataaatcgccgcagaccggtccttcaagcgcaatgccgtatataataatcggcttatcacttatagctgttgctgtcagcgtaactattgttaagtcaaagaaatcaaactaa

SEQ ID NO: 2113 - DNA, 531 bp, Eubacterium sp.
atgaaggtatttaattgtattttgggtattttgactgttcttgcgtcaatttattgcatattttatcccggacttacatttcttaacatcggttggattgtaacgataattctcggattatggggaatttcctcaattgtttcgtatgcagcttcacgcaacgacggtaataataaagaaaaagctttaatgggaactttaggtcttatagcaggcatagctgcggcggttgtgtctgcgcttgcaatgtttatgcccggcataagagtgatgtttgatatattaatccttgcgatttttgcggtatggcttattgtagacggaatctcctctatagcaacatcattcaaggttaaaaaatcaggttcaagtgtatgggtacttccgcttatatgcggagtgctcgtactgcttgcaggcttatacggaatatttaatcttatattcacagcgcaaacactcggactgtttatgggcattttgcttatgacatacggtataagactgattctttcggcatttaaaaattaa

SEQ ID NO: 2114 - DNA, 351 bp, Eubacterium sp.
ttgaaaaataatcaaaaaacaaaacaagcgaccgaacacttaaaatgctcggtcgcttttgtcagcaataattatttatggttgttagagtggcatttccctgccattgcacaggatgcacatccgcagccacagctgccacaagaagatttgccctttttctttgctctgaaatggctgataataattgcagcaactacagcaacaactataagcaaaacaactattgtaccaatattatcaagtaaaaaagtaagcatatacatcctcctctatcaaaatctgaattattttacctttacagaagtttttaatgtattagcctctttgtatggtcttacgagcatataa

SEQ ID NO: 2115 - DNA, 222 bp, Eubacterium sp.
atgaataaaaaattaacttttgaacaagctgacgctaaacttgacgaggttgtggctaaacttgaaaattcacaacttccgctcaaagaaagtgttgattgctacacagaggcttgcgaattacttgctttttgtatgcaggaactttcggaaagcaaaggcaaaattgaagatattaatacaaagttaaataatatttgtactacagacggtgatgaataa

SEQ ID NO: 2116 - DNA, 510 bp, Eubacterium sp.
atttttataacacttagctttagttttgcggaggtaagtatgagaattttagttttgtccgatactcacggagattttaacagaatgatgaaagccgttaccgagcagccgaatgcagaggttattattcactgcggcgacggcgaagaacaggttgaatatttaaaacagaattttaaggataaaatggttgtcggcgtgcgtggcaattgcgattggggcagtatgctgcctgcgaccgaaaccttgagaataaacggaaagacaatttttataacccacggtcatttgtataatgcaaaggtgggactttacacaattatgtgcgccgcacgagaggcaaaagctgatattctctgcttcggtcatactcactctgcgctttctatgtacgaggacggactttatgttcttaacccgggcagctgcggcggatatatggcaagctacggaataattgatattaccgacaagggtgaaattattaccaataccgtagctgtaaaatga

SEQ ID NO: 2117 - DNA, 180 bp, Eubacterium sp.
atgaaggataaggataaatattttgtagaaaccgaaaaccttgcttttcctgaaattcacacaggtaaggtaaagcaaatatcaagcgaaaaacctaatgccgacgaatctgttatttatgatacagtggcagttcccgaaattcatataaaaaagaaaaaagataagcacagcaaataa

SEQ ID NO: 2118 - DNA, 339 bp, Eubacterium sp.
ttaaagaggattatgaaattacgaaagggaaggatatttatgacagtaaatgtaaagggcggaaagcttagcaaaaaggaaattgaggcatacacaacacagcttagagaggcaaatccggataaatatatcaagaatgttgaactcacagttgacggcgactatgttgatgttaaatacgattacgattctgttccgtttgaaagaatccgcagaatcacaggctatcttgtaggtacggtagaccgctttaacaatgcaaagcgtgccgaggttgaggacagagtaaaacacagcgtaccttgtacagaatgttgttccgttgatgaaatcgcataa

SEQ ID NO: 2119 - DNA, 666 bp, Eubacterium sp.
atgatacttgacataatttttcttgctgttataattatctttattatcagcggagcaataagaggttttgcaagagcaattatgaatatagctgcggttgtagcttcggctatactctcaaatttgctttcgggtgtaatatcggactggatttttaattcttttgttagaaatgatttaatagcaaacctcaacaatgcggtaacaaatacagaaatttccgtaaacagtgcactcggcgatttgccgggatgggtgtcttctgtagtttcttttttctgcaacctgtttaattttgatgaacaaagacttgtagattgctttgtgggaacggcatcaacagctaaacttacagccgttcaggttaccgataattttgtaaaacctattgtaacgggtatattctcattttttattgcaataatattatttatacttctgataattatttttaaattgattattaaacttgtaaataaattatttgaattacctgtaataagtccgattaacagagtgctcggcggtgttttcggtgctgccgagggtatagttgttgctttaatatgccttgcagtgcttgcggtaataatggactttacaaattcaaccgctgtgctcaatgagggaataagcggagttgctttttcaattttcaaacgctga

SEQ ID NO: 2120 - DNA, 447 bp, Eubacterium sp.
atgaaatcaggacgacacgcaagaatacttgagcttatttcagaacagtctatagaaactcaagacgatcttcttaattgccttaagcgtgacggttacaaggctacgcaggcgacaatttcaagagatataaaagaccttcgccttgtaaaggcacttgattcagacggaaaataccgttatatgtcacccacaaaaaatcaaaatgaaagaaaatcaagtcttaagtcaatgttttccacagccgtaaattctatagacgcggctcaaaacattgttgttataagaactatggtaggtatggcacaggcagtttgtacttcgcttgattcacttgaccactcggaaattgtaggaactattgcaggcgacgacactatttttgttgcttgccgtactgtaaatgacgcagttaatcttaccgaggagcttaaaaagctgctctga

SEQ ID NO: 2121 - DNA, 258 bp, Eubacterium sp.
gtgatgccgtattctgtagagatagatttgcacggtcacaccgtggaaagtgcgggaaaagttttaacgcaaagattaaagcaattgccgaatgatgtgcgtgaagttaccgttttgcacggatttcacggcggaactgcactgcgagatatggtgcgcagatataaaaatccgaaaattgagagaaaaattctcggactgaatcaaggcgaaactatatttgtgattgcttcgtataataataataaagaaaggtga

SEQ ID NO: 2122 - DNA, 450 bp, Eubacterium sp.
atgggatatttaaaaaatataaacagttacgctttaaatataaaatctgtaagtgatgattttgacggtttaacagttattcttgaaaataatgaaatggaattgttttcaatcagatgggcggatgtggaaagttattgccgttcaacggaagaaatgcgttttaaatttattgcaggtgaatggcaacaagtcagaaaagaatttccaaatcagtcttttttaaaagttattgattcaccatatataaaatggattaaagaacaagcaggtggttttatggacgatgataaattaattcattttatgattgtttctgctgattatgttcttgatacagtttcaaaatatgaaccggatgagtattatttaagtaaactgacttgttcggatagtacaaaaatctctctatggcataatttactgtgtaactttattgattttagctga

SEQ ID NO: 2123 - DNA, 324 bp, Eubacterium sp.
atgaaaaaagacagggtgatatttttggctgataagaataaatctgttcagaacgaatttaacgaagacggcgctttgattgctttgacagacgaaaacggcaaagaagttgtttttgaaattctcggcgttgttgattatgacaatgatgaatttgctgttttgattgagaacagcgcaaatgctgatgaggttgttattttcaagattcaatctcttgatgatgaaaacgaagaatttgtcagcattgaggacgaagagcttttgaataaggtttttgagctttttaaagctcagtatgacggctatatgaaatttgaataa

SEQ ID NO: 2124 - DNA, 714 bp, Eubacterium sp.
atggaggtatttaagatgataagaagaattataaatatagatgaagaaaagtgtaacggttgcggtgcttgtgcaaatgcctgtcacgagggtgcgattacaatggtaaacggtaaggctaaacttttgcgtgatgattattgcgacggactcggtgactgtctgccaacctgccctacgggtgcgatttcttttgttgagcgtgaggctctcgcatatgatgaagaggcggtaaaagccaatatgaagaaaaagtcagaaacattcgacggctgccccggacacagactacagatatttaacagagaaagctctaaaaatactgcttttgctcaagatgtaaaaatgccgtcacagcttggtcagtggccgtgtcagataaaacttgtgcctgtaaacgctccgtactttgacggcgcaaagctgcttattgccgccgactgcacagcatatgcttatgcgcagatgcacaatgattttatgcgtgggaaaattacactcataggctgccctaaacttgacgatatcgattacagcgaaaaactagaaagtataattgcaaataacaatatttggagcgtaaccgtagttcgtatggaagtaccgtgctgcggaggtcttgagtacgccgtaaaaagagcgttgcaaaacagcggaaagtttataccgtggcaggttgttacaatttccactgacggtaaaattttagattaa

SEQ ID NO: 2125 - DNA, 699 bp, Eubacterium sp.
atgtttcttgaaattaagagtatagaaaagtattacggtacaggggaaaatcgtacaaaggtattaaaaggtattaccaccagagttgagaaaggcaagatttgcgttttgctcggcccgtcaggttcgggtaagtcaaccttgctcaacattatcggcggaatagaaaaggccgatggcggcagcattgccattgacggcagtaaaatcgaagatatgaacgaaaagcaactttcgctttacagaagaaatcatctcggttatgtatttcagttctataatttaattccgaatcttactgtaaaagaaaatatagaggtaggagcatttttaagcaaaaatcctcttgatacagatgaacttttgcatactctcggcttgtgggaacacaaggataaagttccgagtcagctttcgggcggtcagcagcagagaacatcaataggcagagcaattgtaaagaatcccgatattttactctgtgatgagccgacaggtgcgcttgattataaaacttcaaaggatattttaaaacttatcgaaaccattaatcaaaagtacggaaacaccgtaattatcgtaactcataacgacgctatcaaattgatggcagataaggttatcaaactcagagacggaaatattcgtaaagaatatgaaaataccgaaaaagttaatgccgaagagcttgattggtaa

SEQ ID NO: 2126 - DNA, 783 bp, Unknown
  Description of Unknown: Clostridiales sequence
atggtgacagaaaaatcaacacaatatctattaatagaattaatgttgcaaaaagagaggagaaagaaaacgatgttgaagcaggaatggcacagtctgttcaaaaataagattttactgattgttacagtcgcggtcatcgcaatcccgacaatctatacgacacttttccttggatctatgtgggatccatacggaaatctggataagcttccggtggctgtcatcaatcatgacgttccggtgacttatgcagatcagaagctggatattggcggcacattgatggacgaactgaaagacaacgattctcttgactttcagtttccgtcagacaaagaagcgcagaaaggacttaaggatggtacatactatatggttattaccataccggaagagttttcagctcatgccgcatcgctgacggatgcgaacccggaaaagatgacgttgtcctatgaaacgaatccgggaacaaattatatcgcatccaagatgagcgagacggcgatgaaggaactggaaagttcagtacgggaagaggttaccaggacgtatacagaagtcctgtttgataaacttgcggaagtgggggacggaatgcaggaggcagctgacggttcgggtgaattgaaagatggggcggatcagttggccgacggaaatcggacgattaccgacaatctgcagattctttccaagagcgctctggtattcgcggatggaagtcaggaattagaagtagggcttgatcagtatacagatggagtcagtgcggcggca

SEQ ID NO: 2127 - DNA, 300 bp, Unknown
  Description of Unknown: Clostridiales sequence
atgagtacaattcagcagttatcggtatttctggaaaacagagaaggaagactcgatgaagttctgcatgcgcttggaacgaacggcgtcaatattgtcgccctcagccttgcagatacaacagagtacgggatgttaagaatgattgtctcagacccggaaaaggggaaagaagagttgaagaagattggaatcacggcaatgctcacaccggttattgccctgagagttccgcatgcaaccgggtctttgagcaaagcgatgcatcagcttgtggaaggcggaatcaacgtagaatat

SEQ ID NO: 2128 - DNA, 420 bp, Unknown
  Description of Unknown: Clostridiales sequence
atgccgattcgagtacaaaatgatcttccagcaaaagaaatactggagtgtgaaaatatttttgtgatggatgagcaccgtgcggtgcaccaggacatccgtcccctgaaaataggactgctgaatctgatgccgctcaaagaggatacggagcttcagcttctgcgttcgttttccaataccccgcttcaggtggatgtgacctttgtgatggtgtccaatcatcagtccaagaacacatcagcaaaccatctgaataaattttatgtccggtttcaggacgtaaaagatcagaagtttgacggatttatcatcacgggggctccaatcgagcagatgccgtttgaggaagtagactactgggatgagatgaaggagatcatggaatggacaaaaaccaatgtcacctccacgattcat

SEQ ID NO: 2129 - DNA, 588 bp, Unknown
  Description of Unknown: Clostridiales sequence
atgctggcaatctataagcgtgagtttaaatcgtatttttactccatgacggggagtattttcatcgcctttctgacctttatgacaggcatctacttcatggcatacaatttaaacagcggatatccgtatttttcctattcgctggaaggggtcatgtttatttttcttgtggcggttccgattcttacgatgcgaagcttttccgaggaaaggagaagccggaccgaccagctgctgttgacctccccggtaagcgtgggcaagatggtaatgggaaaatattttgccatggtgacggtatttctgattccttgcgtactgttctgtgcgtatccgctgattatcagtacacaggggacggcatattttaagaatgattatacatcgattcttgtattcttccttcttggatgtgtatatattgccatcggaagttttatctccgccatgacggagagccagattattgcggccatcggaacatttggtgtcctgatggtgatttatctgtgggatggactgttaagcttccttccgtcttccgcatttggagggatggcaggaatctggatgatgctgaccctc

SEQ ID NO: 2130 - DNA, 507 bp, Unknown
  Description of Unknown: Clostridiales sequence
gaaggaaggagcaaaacggcagcaatggaaaagaaaaagaagagtgtaaaagacagaattgtgtcggcagcctgggaattgttctatgagaaaggatatgactcgacaacagtagatgacattatcagactgtctgacacatccaagggatcattctattactattttgacgggaaagatgctctcttaaacacgttgtcatcggtgctggatgatctgtatctgactttgaaagaagagatggatccttatatggacagctttgagaaactgatgtttttaaattaccgttctcatacgttcatggaaaagacaattaaagttgatctgcttgcgtctttgtattcgacacagttgatttccaaaggggagagaagccttctggatcagaacagggaatattataagctgattgcgtccgtcatcgaagaaggacaaaagcggggggaaatcaacagaagaaaaagcattgcggaggttgtgaagtattactccctctgtgagcgg

SEQ ID NO: 2131 - DNA, 1287 bp, Unknown
  Description of Unknown: Clostridiales sequence
atggattttgagaaaaagatcaaagatgacagagaaagtctgatccgggatattatgaagcttgtttccatagacagtgtggaaagtaaaccggcagagggaatgccgtttggagaaggtcctgcaaaggcacttcaatgttatctcgacctggcggaggcagcaggtcttcagacagaaaattttgataattatgcaggacatgcggactatggaaacggggaagaaacagtcggaattctgggacatgtggatgttgtcccgtgcggggaaggatggatctgtgatcccttccggcctcggattatagatggaaaactatatggaagaggtgtgctggataataaaggaccaatggtggtatgtctccatgcagtaaaaattctaaaggaaatggggattcctttgagcaaaaagatccgtctgattgtaggagcgaacgaagagacagactggaaatgcatggattattattttggagtaaagaaaatgactcctccgcagatttcattcacgccggatgcggagttccctttgaatcatgcggaaaaaggggtgttccagtaccagcttgtgacagacctgaaggaaaagatcgaactttccggaggcaatgcatacaactcggtagcggaatcagcatcggctctccttccggcaggtttggaagaaacggtgcgggagcggatgccaaagtgggaagaagcaaccagctgtaaaatcagctgtgagacagaaaagcagggtgtgaggctgtctgtccggggatttgcggcccatgcggccagcccggctaaagggatcaatgcggtcagcgggatgatgtacatgattgccgatctgggactggaaggggaactttcagagattgcccggtggtatatgaagaatattggatttgaccttcagggaaaaggtcttggaatcgctctttccgacgagatctcaggggctctcagctttaatgtggggaaagtggaagtcattgatggaaaactgatcctgtccattgataaccgggttccggttacatacaaatgtaaagaagtgcaggatctgctggaaaagaatctggaaggaagccggttccggtttgaaaatcctcagattacagaagcaatctatgtgccaaaagacagcttccttgtaaccacactgatggatgtttaccgggagataacacaggattatgacgcagaaccacaggtggacggagcgtgctcctatgcgagagcactggaaaactgtgtagcgtttggggctattcttcctggacagccggatctg

SEQ ID NO: 2132 - DNA, 438 bp, Unknown
  Description of Unknown: Clostridiales sequence
aatctttgccgttattaccttgcggcctatgatttcctgagcggagatctcctgtatgcagcggctatgtatcatgacatcggaaagacaaaggaactgtctgcatttccggaaaatgattacacagatgacgggcagcttcttggacatattattattggtgtggaaatgctggatgacgcaatccgtacaataccgggatttccgccaaagcttgcaagtgagttgaaacactgcattcttgcgcatcgcggagaactggaatatggttctccgaaaaagcctgcacttgcagaggccatggcactcaatcttgctgatatgacagatgccaagatgcagacgatgaaagagctgtttaaggataaaaatacgacagagtggatcggatataacagactgtttgagtcaaacttaagaaaatcaagtttgtcatag

SEQ ID NO: 2133 - DNA, 792 bp, Unknown
  Description of Unknown: Clostridiales sequence
gatgaagtcccgggagaagaccaggatgaaaccgtagaagaaaatccggacaacattccgggagacgttttggaagaagaaccggcaagtgaggaaggtaacataacggaaaattcgtatacagagaagtcacctgagagtgaagagcctgcggaacaggcagtgacggagatgcaggaacttccgaaagaaaaagtaagatcagcgaaaccggcacttacgtatcaggcacatgtccagaatgagggctggcagaactggaggcaagagagtgaactggccggtactgagggaaaatacagacggatggaagcgctccgaatcaaactgcagggcggagaagatgctgttcagggaagcgtggaataccgggcacatgtacaggattacggctggatggattggaagaaagatggagaactgtctggaacgcagggacaatcgaagcggatggaagcgattgagatccgcctgacgggagagcttgccgagcagtatgatatttattatcgtgtacatatccaaaattatggatggctggactgggtgaaaaacggcgctccggcaggaagttctgcactgagttcacggatggaaagctgtatgatccggcttgtggaaaaaggcgatccatcaccggcagcaggaacaaggggatttatcaaagcatatacgaatacggatttgacttatcgcgggcatgttcaaaagattggaaatacaaatacatccgtcaacgggcagattatgggaacagttggaaagagtctgaggctggaagctatgaccatg

SEQ ID NO: 2134 - DNA, 405 bp, Unknown
  Description of Unknown: Clostridiales sequence
cgcgaactgctcacattccgcagctattatgatgaaatcatggatcttggacgtgcacttgaagaaaatgaaaatggcttttttatcaagaaacatctcaagtattttggcacgatcggagaccgggccgaccggctgttgagtaaaacaaaccatctgttggattacgcacaacagattaaagaagcctaccagtcccagatcgatgcccgccagaacaacaacatgcagtttctgaccgtaatttccaccatcttcttcccgctcacccttatcaccggatggtttggaatgaacttcaaatacatgccggggctcgacaacggctatggaaacgtcgtcatactatgcattctcatcatcatactatgcatcattatattcaaaaagaagaagctgatttga

SEQ ID NO: 2135 - DNA, 528 bp, Unknown
  Description of Unknown: Clostridiales sequence
aaagacaagccggcgattgtaggtggaaaagagatggatttcacctacggtgactgtaaaaaagagatggatatggtaaataaggcattcattgaagttatgattgaaggagatgcccagggcagaggattccagtatccgattccgacctattccattacaaaggatttcgactggtctgatacagagaacaaccgtctgctttttgagatgacatcaaaatatggaacaccgtacttttccaattacattaacagcgacatggagccgagcgatgtccgcagcatgtgctgccggctgagactggatttgagagagcttcggaagaaagcgggaggatttttcggaagcggcgaaagtacaggatccatcggcgttgtgacgatcaatcttccgaggatggcttatctgtcaaaggatgaggatgatttcttccggaggctggcccatatgatggatattgcggcaagatcccttcatattaagagacaggttatttccaaactgctggatgaaggactctatccg

SEQ ID NO: 2136 - DNA, 642 bp, Unknown
  Description of Unknown: Clostridiales sequence
atgggagaaaataaaatcaaagtcagtgtcattatgcctgtctataaggtagaagaatatgtaggaaaggcgattgagagcattcaggcccagacattaaaagactgggaatttttgatcgtcgatgacggaactccggaccggagcggtgaaatctgcgatgcctatgccgcagaagatgagagaattcatgtgatccataaagaaaacgggggagctccaagtgccagaaatacagcaattgatattgcaaaaggggaatacatgtatttcatggattccgatgactgggcagagccgaccatgctggaagatatgtacaagcttgcaaaacgtgataacgctcagcttgtcgtggcaggattttatatcgatacctactacgataaagagaattatgtgacagatgactatgtggtggaggatgccgtatatccggacaaagagtctttccgccgcaatgcctacaaactgttcgataaaaacctgctctacacaccgtggaacaagctttttgaatccagatacatcatggaaaacaatcttcggtttccggaaacattctgggatgatttcccgtttaatgtcagcattgtaagaaacgtagaacgggtgacagtgactcacagacagtactaccat

SEQ ID NO: 2137 - DNA, 735 bp, Unknown
  Description of Unknown: Clostridiales sequence
ggaaagcataagaggagaagaaaaatgaagcgtatattaatgatggtcatccggaatctgatttttgttccgtacggatggattaaactgtgctattacgccagccacgtagataaatatacggaagaagagcgataccgccttttaaagtatattgaccacaaggcaaataagggaggcagcgtccatatcgaagtacacggacaggaaaacatcccgaaagaaaacggatttatgtttttcccaaaccatcaggggctttacgatgtgctggcagtgcttgaggcatgcccggttcctttttcggttgtcgcaaaaaaggaaattgccaatattccgtttctgaaacaggtctttgcctgcatgaaggcgtacatgattgacagggaggatgtcaggcaggccatgcaggtcatcatcgatgtgacaaatgaagtgaaaagtggaagaaattacctgatttttgcggagggaacaagatctaaagagggaaataaaccggggactttcaaaggaggaagcttcaaatcggcaacaaaggcaaaatgtccgatcattccggtggcactgattgacgcatttaagccgtttgatacaaacagcatcaaaccggtgactgtacaggttcattttttgaaaccgatgtattacgaagaatacaaagacatgaaaacgacggagattgcagcagaggtaaaaaaaaggatcgaacagacaatagaagagaatatctga

SEQ ID NO: 2138 - DNA, 714 bp, Unknown
  Description of Unknown: Clostridiales sequence
ctgacatttcttccggtaattattttgaataccatgattggtatcattcaggagatccgggcgaagaatgtgctggataagatgacgatgcttcatgcaccgaaagccacggtagtacgcaacgggcggaaacgggtgattgcggtggaggatcttgttattgatgatatcgtgattttcaaggcgggtaatcagatctgtgcggatgcgattgtagagcacggggaagtgcaggtcaatgagtcgcttctgacaggtgaggcggatgagatcacgaaaaagaaaggcgatattctgatgtcgggaagcttcatcgtttcaggagaatgccatgcccggcttgaaaaggtgggggcggattcctatatttccagactgacgctggaagcaaaggccatgaaggacggtgaacagtcggagatgatccgctctctggacaaactggtcaagtgcgttggtattgccatcattccgatcgggctgattctgttcattcagagcttctttttaaatgaggaaagtttccgttcaagtgtcactgccatggtagcggctgtcatcggaatggtcccggaaggtctttatctgcttgcaagtgtggctcttgcggtaagcgcagtgcgtcttgccaagcagaaagtacttctgcatgacatgaagagtatcgagactctggccagagtcaatgtgctctgtgtggacaagacaggtacc

SEQ ID NO: 2139 - DNA, 459 bp, Unknown
  Description of Unknown: Clostridiales sequence
atggatctggtcaagaaggtgatagtgcttgtctgcagtatcatcctggtagggtttaccctgaccgatttccattctgtcattgcggaggatccggcgtatgccggacatctttttgtcaataaaccggagaagcagacactcacagcacatgagaagaaaagccatcctgattcggacgccaacagagaagaagccggaattatgtggaagtatctgagaagtggaaaacagaaagcggccagaggactggcactttccacgatctttctggccgggtcggctgctgcattgttccggatttttgaaaaccggcattatctgggaggtcttctccttcaggtagtttatatggcacggttcctttatgaactgtcagtgcagaaagacaaggacggcaagaaaagaccttccgcacggaggcttctgctttcgttccaggacagttcaaaaatataa

SEQ ID NO: 2140 - DNA, 663 bp, Unknown
  Description of Unknown: Clostridiales sequence
ctcgacagcgatgatattccgcatccgccgctggaagttattgtgacaacagacgaagagatcggaatgggcggagccaatgcccttgacatgtcacagatcaagggaaatattttcctcaacatcgacggagaagaggaaggcattattcttgcaggctgtgcaggaggtgttcttgagactttgaagattcctgcagagcgggaagaaaagagcggttctgtgatgagaatcaaagtaagaggactccggggaggacattccggatcccagatccacgagcagcgtggaaacgcaaataaaatcatgggaagaatcctgaatcatctcgatcagggtactgagattgctcttgtatccgtaagtggaggttcccaagataatgtcattgccggtacggcagaagcagtaattgcagtggcagatccgaagaaggctcaggagattgtatctgacatggaagctacattaaaggcagagttttcctctgatgaaccggatcttcaggttccggttaccgtcacggaagagacggtacaggcactcacaaaagaagtcacaaagaaagtgatttttgcaatggtctgcacaccgtacggtgtacagggactcagcagagatcttccaggtgtggtagagacttccctgaatcttggtattgta

SEQ ID NO: 2141 - DNA, 624 bp, Unknown
  Description of Unknown: Clostridiales sequence
tttatgtcgatctattattccgactccgggactgcgacagtgctgcagtatctgtccacgatcattatcttgattgtcacctgcatccgcaccagaacgcttccgaaaaagacggaaacggcagcgatcgtcgccgcggtggcaggcacctttatcatcagcaccgggggacggccggggaaccttgcaatctccgggtacgccctgtttttcggtctgatctgtgccttttcctactccacttacaccctgattccgggaaaaattgtgcggacttacggcgccaaatacatcgtggggcgcggaatgctgatcagcggaatctttttctccatttttgtccgcccatggacctattccatcgacatcacgccgcaggtcatcctcggattttgcgggctgatcctgattggaacagcggccggctccaccttctatcatttcggagcatcactgctgcctccggtgaaggccggaacccttgcaaactttgatccggtctcctccgtgatcctgaccgctctcctgcttggcacccggtttacggccgccgatcttgtaggatttttctttattatcggagcagtatttcttctgaatatttatcaggttaaaaaagcatag

SEQ ID NO: 2142 - DNA, 564 bp, Unknown
  Description of Unknown: Clostridiales sequence
gaggagaaaatctttggatggcatacaccggcatcaggaaagtatacagactttctgcatgtgctgcttccgcagcttacgggaaagctgaaagaatgggggatcgctgaggtaacctggtttcatctgtccgacgaaccacgagaggaagatctggatagttaccgtgcggcgagagaatctattgaagacctgctggacggatttcatacgatggacgcactttcggactatgaattttatgaacacggactcgttgagcagccggttccggcaaatgatgcgattcaagaattcctgaaccacggagtagaaaatctgtggacttattattgtgtgtcgcagtcttatgaggtaagtaaccgatttatggcaatgccgtctctccgtaaccggatttacgggttgcagctttataaataccggattgccggaattctgcactggggttataatttttataacagtcagtattctttggaaaaactgaatccgtatcaggtgacagacgcagggggatgttttgcggcgggagatccgttccttgtttatccgggaacagac

SEQ ID NO: 2143 - DNA, 585 bp, Unknown
  Description of Unknown: Clostridiales sequence
ttagataaaatgatcagccagattctggaagaagcggatgccgcagcatcacagaaagaagcggacgccgcatcacgtgctgaagcgatcctttcggaagcagaaaaagaggcggagatcctgaagacggagattgaagaaaaatctgaaaaagaacttgcaggatatgagagccgccaccgcctggccgatgagcagaagaggcgaacagcccttcttttggcgaagcaggagattatttccgatacaatcgaaaaggcatatcagaaattctgctcgatggagacagaagcctattttgaagtgattgcaaaaatgattagaaaatttgcgcttccgaaggaaggagagatactgttttccgaaaaagaccttggaaggatgccggaaggatttcgggcggaaatcgcccgggcagcaaaagaaaagggcggcagtcttactgtttccggtgagacaagacggatggaaggcggttttgtccttgtatatggaggagttgaggaaaactgctctttcagggcgctttttgattccagaaaggatgagctgcaggataaggttaatagattattatttttttag

SEQ ID NO: 2144 - DNA, 477 bp, Unknown
  Description of Unknown: Clostridiales sequence
atgtgcagtaattgtaatgaaaaagaaaagtattatatcacgactgcgattgcctacacatccggcaaaccgcatatcggaaatacgtatgagtttgtgcttgcggacgcaatcgcaagatacaaaagaagcaagggctacgatgtctatttccagaccggaacagatgaacatggacagaagatcgagctgaaggcggaggaagcaggcgtgactccgaaggagtacgtggacaaagtagctgcccaggtgaaagagatcgctgacatgatgaacacatcatacgatcattttatccgtacaacggatgactaccatgagaaacaggtgcagaagatcttcaaaaagctgtatgatcagggagacatttataaaggatactatgaaggaatgtactgtactccgtgcgaatccttctttaccgagtcccagcttgtggacggtaaatgtccggactgtggacgtccgtgtacaccg

SEQ ID NO: 2145 - DNA, 813 bp, Unknown
  Description of Unknown: Clostridiales sequence
aggaaaatcgatgccgttacagatgtcaagatccgctacatgatgtacgcttatgatcagaacggcaatcttcagtctatcggcgttctgaacaaagaacagttcgatgacgaagaataccaggggtcattaaaaggagaagttgactacgaaaccgcggcgaaaaacggagacatcctttacggctggtcttatttcatcgaagagagcggttatgatctcggcgataccgtcactatgactatgggagacgcaggtggcgaagccaggttccagggaacaatgacaggagccttcggaagcagcaattacgactggattatcacagatgaagcctatgatcagctgggactttccggaaaaagcatcggtaccatctgggtagactgccgcccacaggactgcgcagacgtacaaaaccagctggaagacctgctcacggataaacagcattacgaattcagcacctaccagggtgcactggagacatccgaaagcagcctcggcatgttcgagacacttgcctacggcttcctcctcctcgtcggactgatcgcattcatgaatatggcaaataccataatcatcagcatcatcacacgaaaacgagaactcggcgtcatgcaggcactcggcatgacaaacagccagatgaacagcatgctcagaaacgaaggagtcctcttcaccgccggaagtatcctcgtatccctcctcgtcggcatgccggcaggatacgcacttttctgctacggaagagaacacggatacttcggtctggatgtgtaccatatcccggtcatcgagatcgct

SEQ ID NO: 2146 - DNA, 534 bp, Unknown
  Description of Unknown: Clostridiales sequence
gaaaaaagagaaactctcggagggaatctttactgtgaggatatcgagggaattcatgtacacaaatatggcgcccatattttccatacaagcaacaggaaagtatgggattttgtcaattctcttgtagagtttaaccgttatacgaattctcctgtcgcaaactacaaaggcgaaatttacaatatgccgttcaatatgaatactttcagtaagatgtggggaattgcgactccaaaagaggcggaagaaatcatcaacagacagaaggccgcagttaagggagaaccgaaaaacctggaggagcaggccatcagccttgtaggagaggatatttataaaaaactcatcaaaggatacacggaaaaacagtggggcagagactgtaaagatcttccggcgtttatcattaagcgccttccggtgagatatacctacgataataactattttaacgatctttatcaggggattccgatcggcgggtacaatgttttgattaacgctctgtttgaaggatgcgatgtagagctt

SEQ ID NO: 2147 - DNA, 561 bp, Unknown
  Description of Unknown: Clostridiales sequence
cttgatcagtataaagtaaaaggaactttctttgttaccggaaataatcagaaaaagaatgatctgatccgtcttgcttatgagaagggacattccatcggtcttcatacatatacgcatgactatgcttcagtctacgcatcggaagaaaattattttaaagatcttcaggaaatatccgatatggtggaaaatgtcaccggagagaagtcctgcctgatccggttcccgggaggttcaagtaataccatcagtaaaaagtatgtaccggggctgatgacgagactgacaaaagcggttcaggaaaaaggatatcagtattttgactggaactgtgattctacggatgccagcggaaataatgtcccggaagaaaagcttgtcgcggaagcaacatcatcctgcgcaaagcatatcaatatcctgatgcatgatactgatgcaaaggatacgacagtaaaagccctcccgaaaattattgaacattaccgtaaacttggatatgcgttcaagggtctgacgacagattcctatgctccgcatcatcatgtgaataactga

SEQ ID NO: 2148 - DNA, 414 bp, Unknown
  Description of Unknown: Clostridiales sequence
atgcattgtactagaaaagtaacagatggaattcattgggtaggagcaaatgacagaaggatcgccaagtttgaaaatatgttcccggttccaagaggagtttcctataattcttatgtgattctggatgagaaaacagcactgatggatacggcagacagctcagttgcagagagatttatggaaaatgtggaagcggttctggatggacggacactcgattatcttgttgttcagcacatggaaccggatcactgtgcaaatattgcggcaatcattgagaaatatccggaagttactgttgtcggaaatgcaaaaaccatgcagatgatcggacagttttactccggaacaaaggcagaaaacaccctcctcgtaaaagaaggagacaagctgtctttaggagagcatgag

SEQ ID NO: 2149 - DNA, 555 bp, Unknown
  Description of Unknown: Clostridiales sequence
actgtccgcatccggacacgggacggacgtatctatgacgggacatgccagctttgcaacgcctctgttcacgtaaatggtaaatacgcggagacaaagcggacatacgatgtgatggagattgttgttgacgaaaagacatcttccaaagaggagacggagaagctgggaattatgaccggagattttgtctgctttgaaccgagaacaacaattacaaagagcggctatatcaagagccgtttcctggatgataagctcagtaccgcaatgcttcttggatacgcaaagcatatcaaagaggatggcgtgactccgaagcggagaatttatctccacatgacagtttatgaagaggttggacacggcggatccgcttccattccggatggtgtgacagaagtgctttccgtggatatgggatgtgtaggagacggtcttgcctgcaaagagcatcaggtatcgatctgtgcaaaagacagcaagggaccttacaattatgatgtcgtttctaatctgattgaggcggcgaaaaaagcgggatgcgattttgcg

SEQ ID NO: 2150 - DNA, 738 bp, Unknown
  Description of Unknown: Clostridiales sequence
atgagtttttttgacaattatcagtttttctgtgtccttattctcattcttcttccggcattactgctcggtattctggagcagccgctgaaatggtactctactgccgcaaccattttatttaccgctctggcctttttttcaaaaccggagcaggcagcttacctgattctgttttttataatcgaactgactgttgtaaaagggtacatggccttgcgtgtttccagagaccggaatgtccgggtgtacaggctggcactgtttttgagtattctgccgttgattctcagtaaactggccggactgtggggagaatccatctttgcgttccttggaatttcctatctgacattccggtgtgcccagatcattatcgagacctatgacggattgattaccgaaatgtctgtctttgattttacagcctttgtgctgttctttccgtctcttagttcaggtcctatcgaccggagccggcggtttctggaggacctgaacagtatccggccccgcagagagtacctggcgcttgccggagaaggcatatttaaaattctgcttggactgatttacaagctgattcttgcctctgtgttctttaaaggcatgggaatggttgacggtgcccgcacatggtactatgtgattttctatgcgtactgctatggattttacctgtttttcgactttgccgggtacagtctgatggcagtcggcaccagctatcttcttggc

SEQ ID NO: 2151 - DNA, 213 bp, Alistipes sp.
ccaccggaaccgccattccgtggacaaaggcccggtgtcagtcggcttgtccaccggatcgccattattgtggctaacttcttcgtgttgagcctagtattaaggaaagacagtctgaaagttgtatctttccttggaaataaaagcggattgctgtttggtgaagtcagaggtcactttctgcgcatagagaaaagggttatgaggcagtag

SEQ ID NO: 2152 - DNA, 279 bp, Alistipes sp.
atgactccctcgacggtgtacaaactgaggtataacaaggaaaacgtattgatgggtatggagaagaccaatacagggctcgggaaaaagacattgggtcgcacgctgtgtgtcctgatactcctcaagctattcatcatgttcgccgtactcagggtgttcttcttcagacccaccctcgcgggaaagacctatgaagagaaagtcgaggcggtgggtactaatctttcatcaatgaatgtgaatatgacagtgtctgtagacggcggagggcaatag

SEQ ID NO: 2153 - DNA, 255 bp, Alistipes sp.
atggcaaatcacgcatcagcaaaaaaggccaatcgccaaagcgagaggcgcagattgcataacaagtattatgcaaagtcaacgaggaacgcgatccgcgcgattcgtaacactacagacaagaaagctgccgaggaaggcgctcctaaggtctatgcaatgatcgacaaacttgcaaagatcggagtaattcaccagaataaggctgcgaacttgaagagcgggagagctgtttacatcaacaagctcgcgtaa

SEQ ID NO: 2154 - DNA, 216 bp, Alistipes sp.
ctccagatccttgaaggaaggaatgtcggcgaaggcccagactatgaatatcataaggaaaaggagcagtaccggaaacgtgatcagaatccagaaccacttggtgattttctttcgtgtcgcatcggtcataacaaggacaaatttaaaacaaaatttggaaaattgcccagtttgtggcttactttgcagattgaaatggcaaactatctatga

SEQ ID NO: 2155 - DNA, 189 bp, Alistipes sp.
gttgccctgctgaaatattcattgaatattcatttattgtcttttttcgccaagatgaccgctcaaatttgtgtttggcgattattaaggttaattttgaaggataatattcataaacggcaaagagtcagtgccgtggatttggcaaagattgccgagaatgaggctataatgttgattatttggtga

SEQ ID NO: 2156 - DNA, 591 bp, Alistipes sp.
atgtttgagctgatctacccggccgccccggcggtcatactgcccttgccctccattgacaatccgggcgacagtccccgcaaggctggggagatggttcctgtcgtcgaggagaacggacttgtggtcggacagtccctccggaagaacgtccatgacggctcaaaactgatgcatcctgtcgtccatcttcacatcgtcaaccgagagggatgcctgtacatccagaagcggtcgatgaggaaagaccttcttcccggctgctgggacacggcggtgggcggtcacgtggactacggggaaagccttgaggaagcactctaccgtgaggcctcggaggagctgggtttcaaggagttcaatcctatctatctgaaatcctacgtctgggagtccttgagggagaaggaacttgtcaatgtcttcgcggcagtcgggaacttcacgcttcatccggatcatgacgaggtggaggagggacgttactggaatatgtccgagatcgagtcgggtctgggacgcggactgttcactccgaatttcgagcaggagttcagatcaatcaaaaacacgttattggcattactctga

SEQ ID NO: 2157 - DNA, 432 bp, Alistipes sp.
atgatgaggaaaaggaatattctgacattggcgctgctggtcgtctacctcggaatggtcggctggtgctgtttcgggcatttcagcgacttgcctgacatcggccaggacaacctgttcgggattccaatggacaaggtggtgcatttcctgatgttctttcccttccctatcctctgctacctcgcgttctccgggatgacaggcaggccgcgacacaccgtcctggccgtcggcctggtctttctggccggttgcctgatcgccgccgggacggagatcgggcagtcattcacgagctacagaagcggagacgcgctggatttcgtggcggacacgcttgcactggccatttcctccatcatcgtgatgatcattgatttgcggataataaaaacacacaataaaccgaaatgctcaaaagaatcataa

SEQ ID NO: 2158 - DNA, 651 bp, Alistipes sp.
atggtaagaatagcaccttcaatactttccggcaattttctgaaccttgagccggacatcagaatggtcaacaagaacgccgacctgatccacatagacgtgatggacggctcgtttgttccgaacatctctttcggattcccggtcgtggaggcgatcgcgaaggccgtgaccgtgccgatggatgtccatctgatgatcgtcaatcccgacaagtacgtggaaaggttcgcgaagacaggcgcggagatgatcagtttccatcttgaggccgccgaccaggcgggcaaggatcccagggacatcatcgcccaaatcaagtcattcggagtcaaggccggtcttgtgatcaacccggacattccggtggaaagacttttcccttacatcgacgatgtggactttttcctgataatgtcagtgttcgcaggcttcggcgggcaaaaattcatcccggaatcgattgacaggatcaagaccctgaaagcggagatggacagaaggggagtagtgaaggacatcgaggtggacggaggcgtgtccgcctccaacgcccacatcctggccgaggccggtgccacgatactcgtcgccggcagttccgtattcaaggcggaatcccctgcaaaagctattaacgagcttcgttag

SEQ ID NO: 2159 - DNA, 351 bp, Alistipes sp.
ttgttgaaacctttgtggaaaaaattggaagcaagtggaataaattggaaaaatattcctaactttgtaaccaagcgtgaaaggctaaagacaatggtaacattcatcggagaatattcaggaaagatcgacgacaaagggagagtggttttcccttcgccgttcaagtcactgatgccttccgagggagaccagaggctcgtcgtcaagaaggacatctttgaggactgccttgaaatgtacaccttcgaggaatgggagcgccagtccgaagaggtgaagtcaaaactgaacatctttaatcgtactcacgccgctttctggagagagtacatgcgcgacagggctgtc

SEQ ID NO: 2160 - DNA, 456 bp, Alistipes sp.
atggtaacaaacatcgcattggtcgcacatgactccaggaagcaggagttgctggattgggtacgttacaacgcaggctcgctgaagcactgccatttgttctgcaccggcaccacaggccgcctcgtctcggagacgcttacagaaaagctcggccccgaggctccctccatcgtctgccttctcagcggtccactcggcggggacttcgagatcggcggcatgatcgccgaggggaagatcgacatgctggtgttcttctgcgacaacctgatcatgcagggtcaccagaatgacgtgatggggctggtccgcctggcctccctgtacaacattccgttcgccacgaaccgcagcaccgccgatttcatcatctcttcccctctctacacaagcacccagtaccgccgcatgatcccaagctgcatagactcctacaaaaaccgcaaactgtag

SEQ ID NO: 2161 - DNA, 675 bp, Alistipes sp.
atgatgacgttcccggaattcgagacctttctgaaagaatcgttcccggaagtctccgccgaagcctcggagcgcttcaggatgatggaagcgggctacacggagtggaacgcgaggatcaatgtcatctcgcgcaaggacatcggcagcctctacgaccaccacgtcctccactccctcgcaatagctgaatatctccgcacacggcgtccggagacatattcatcattcctcgcgccagacaacgggacaaggatcctcgaccttggcacgggcggcggcttccccggaatcccgcttgccgtgatgttcccaggagcaaggttcaccctctgcgactccgtgggcaagaaaacaatagtggcaagagagatttcgaatatgcttggccttggcaacgtggagattgtcaacgcccgcgccgagagcctgaacgagaagttcgactttgtggtctcccgagccgtggcctcgctgacggacttctatccgtgggtcaagggaagatattcacaatccatcctctacctcaaaggcggcgagatcaacgaggagatctgcgccctgatgtcccgcgagcgcctccgcaaaggctccatttccacctggcagataggcaactggctgaaagacccctacttcgaaggcaaattagtggtggacatcagccgctag

SEQ ID NO: 2162 - DNA, 774 bp, Alistipes sp.
ggcagaggtggcgttcgggacgcagggtgcgaggatggccgttttacagaaggcggagtggtggcgctcgggacgcggggcgcgaggtgggccgctttacaggagacacaaagggcggaagtgttaaatggaaaaatgaatatgctcaatcaggaactggtgcaatacgttgagggcgagatcattcctcgctacgcttcctttgacggggctcatagggaggatcacgtccggaaggtgatcgaggaggctatgaatatgtccgctcactatgacgtggacgagagcgtgctttttgcggcggcggcgttccacgacaccggtctggtggacggcagggaagtgcatcacctttcctccggcaggattgtccgcgaagaccagaatctcaaaaggtggttcagtccggagcagatagagaccatcgcccaggccacggaggatcatcgtgcatccggcggcagagatcccaggagtctctacgggatgatcgtcgccgaggctgaccgtgacatcgaacctatgagaatcctctggcgtacagtgcggtacggcatggaacattaccctgagttggacaaggaaggacattggcaaaggatgcttgagcacctggccgagaaatatgactacggtggttacctcaaactctacatcccggaatcaaggaacgccgccggccttcaggaactgcgtgacataatccatgacccggcgcggctcaggaatatattcgagaattattataaggaggaaaagttgcgaatattatga

SEQ ID NO: 2163 - DNA, 453 bp, Alistipes sp.
atgttggagattggaacaaaggcgccggagttcgtgggtacggacgagaatggcaaagaggtcagcctcaatgacttcaagggacataaacttgtactttacttctatcctaaggacagcactccgggctgcacggcggaggcgtgcgacctgcgggacaactaccaccgctatctgtcgcttggctatcaggtactcggggtcagcaaggactctccggcttcccaccggaagttcatcgagaaatattcactccccttccatctgatcagcgatccggactgcgtcatcctgaaggcctacgaggcctggggactcaagaaactctacggcaaggagtcgtggggaaccctgaggacgacctacgtgatagacggcgatggaatcatcaccgacgccatcggcaaggtcaacaccaaagaccacacctcccagattctcggagaagaatag

SEQ ID NO: 2164 - DNA, 783 bp, Alistipes sp.
gttatgaatatgagaaagaacgttttcaatcttctcgtctgcgccgccgcggcagcgatgatcatcggctgcggaaacggtgcgagaaaagccgccgcggaggctgaggccgccgcggagcaggctcgtttggattcagtagaggcggctcagaaggccgagaaagcaaaagaaattatggagaccattgcaaatctgccggaagagccggtttttgacatcgtgacgaaccttggaacgatcaaggttaaactttacagcaagaccccgaagcatcgcgagaacttcgccaaactggctttggaaggctactatgacagccttcttttccacagggtgatcaacggattcatgattcagggcggagacccgttcacgcgcgacacttccgccgccgcggtggccaagtacggtcagggtggccctggctacacgattcctgccgagttcgttcctgaatatacccacaagaagggcgctctcgcggctgcccgaagaggcgatgtcgccaacccgatgaaggaatcgtctggctcccagttctacattgtgcagaaccctgaggcctgcgcccagctggacggaggctacaccgtcttcggtgagacggtcagcggactagacatcatcgacaggatcgcccaggtcgccacagaccaaagggacaaacctctgatggatgtacgcatcaagaccgtcaaactcgatgagtcctgcctgccgaaggtggagaaatccgggactgaggccactgaggccgagtctgaggcggctcaagagtaa

SEQ ID NO: 2165 - DNA, 222 bp, Alistipes sp.
gtgattttagcacaagacctgttctctttgcctcgaattatcccgaatattccagaacattatcctgattattccggggaaaatggaataatttgtataattttgaacggaacgattatctttgtattcttatgtaaggaattgtttattacggcaatttccaagtgtgcggaaggaatttgtgttgccgcggaagaggcggatttattattggattactaa

SEQ ID NO: 2166 - DNA, 477 bp, Alistipes sp.
atgccgctgtcatcggagcgggaagaagatctggaggaagagcgagacattgacgtggaacttctcacggatgtcgcggatgacctgtcagaggatgagcttcttaccgaagatgaatttctgtcggacgatgatgagctccttaccgcagagccggagcttgagcggcggttgccgtcctgcgagcttctggtcgaagcggatgaggagtttcttgacgatgacgacgagcttcttgaggatgaagaacttctcgaagacgaggacgagcgtgtctgcgacgatgtcgtgttactcctcgaaccagtggaacgtctttcctgtgaatatgaatctaccggaacggcaagcatggccaacgtgattgctgacgcaagcgcgaagttaagaaaattcttcatgacaataagtgttaagtggttaattatagagccaatactttctggaaagcttcttgaaagcctcgacatcctttga

SEQ ID NO: 2167 - DNA, 687 bp, Alistipes sp.
ttgtttgaattgttctttgagaagaaaaatcttcattttagacaaaaaaacaaaaacagcttccaaaaccgcatcattacaatggacattttgagcaacaaagttctgattttctccgccccgtcgggatccggaaagagtacgattgtaaatcacattctcggaatctataaggatgcgatggagttttccatctccgccacctcaagagccccgcgaggcacggagcaagacggcaaagagtactacttcgtcacgccggaaaggttccgcgagctgatcgccgatgactccttcgttgaatatgaggaggtctacgaggatcacttctatggaacgttgaagtcggaagtccagaggatctgggcggcgggccacgtgatcatattcgatgtggatgtgaagggtggagtcaacctcaagaaatatttcggtgacaaggcactctccgtcttcgtccaggccccgtccgtggaggcgctcagggaaaggctcgtcaagaggggcaccgactctcccgaggccatagacgagcgcgtggcgaaagcggcggaagagatgacctacgccccgaaatttgactatgtacttgtcaatgacaacctccagaccgctttcgcggagtccgagaaggttgtcgaagactttctcgacgacggaaaactgaattattcaacaatagtgtag

SEQ ID NO: 2168 - DNA, 183 bp, Alistipes sp.
atgctctcccgcgcgtttcgggagggtgtcaagccaaaattttctttgatttctatgaagttttttcttgttgttccccttgacggttgcgaaaaatatgtatttttgccacatgaaaaagttccttacagccgcagtccttgcactgctttgcgccgtggcacttccggcgcagaccaagat

SEQ ID NO: 2169 - DNA, 129 bp, Alistipes sp.
atgagaaacactgaatatagtctcgaaaagctcgcatccatgatctcgtcggagtcatcgttcaacgccctgatggagattatgggagacatggggctggagttcgagagtgcggtcaggaacgcctga

SEQ ID NO: 2170 - DNA, 276 bp, Alistipes sp.
atgtttacagtactgctgtgtatgttcgcagggatagcggtcggatggctactgaggaaccgcgattgcggatgggcttcgaaaacggtgaccgtcctgatctgggcgcttctgtttcttctgggtgtcgaggtcggcggcgacaagaagatcatctcggcgcttccgtcgctcgggctggacgctcttgtcattgcggttttgtcaacggtcggcagctgcctgctggcctgggttctgtggcgttacattaaatcctgcaagaaagagtcatga

SEQ ID NO: 2171 - DNA, 225 bp, Alistipes sp.
gtcattgtccctccttccggcgctctggttgaggatcttccggacgactacgacaccatcacccttgacgggatggatttctacaaggtcgatgacaccgtctatcgccttaccctcgtcgaaggaaagccttatctggaggtgctcggccagatgtacggcaggctcgccaaccagtacaactattactccaacagggctgtctcctacaacagcctctactaa

SEQ ID NO: 2172 - DNA, 288 bp, Alistipes sp.
atggtcgtgcgtcacaaggtcaacaagcctctcaatgaaaaacgcggtgacgatcttggcggggcgtcaattctggttcttgccgtggcagtggcggtaggagaggtggctgccgcaggggcagggggcgtccggtggggtcggggggacgaagagacccaggagagggttcttcctgatcatggactggagagggtcgtcctcagtctggaggactaccttgaggctgttgacctcgttggaggaatagcccttcaggagccacttggggagggtgttcgcataggc

SEQ ID NO: 2173 - DNA, 798 bp, Alistipes sp.
atgaacagaataaccaaactctcaaccagtgtgtttctcctgctcgctatgctggcatattcaaacacagaggcatccgcacaggaaatcaatggccgcgtctatgcggaggctgactggaaggtctccaaaggcttccaccttaacgccgagtaccagctacgcaccaaggactcgttctcgggcattgaaaggaatcagttcgccctcggcgcatcctacaagatcaacaagtacctcaaggccggagccgactacacattcatcggccactatgccaactccacaggcaaattcaagccccgtcacagggtggccggcaatctgaccggcatggttgacgccggctactggcgcttctcgctgcgggaaaggcttcagctcacccacaaggcctatggtgtgaatcactatcaggaggttcccaatcatctggaactcaaatcaaggctgatggtaaaatacagaggattcaggacagtgtcgccctatgcctacatcgagttgcggaacacattcaacgatcccaagtgcgacgccaactacgactcatccaccggcacgtggagcggctacgagttcctcggctacacccacgcctacgtcaaccgtgtccgcggagccctcggtctggaatggatcctgagcttgcggcacgcacttgacttccggttcatgtacaactactacaacgagctggacatcgacacggacaaatccggcaccatgctcaagtccctcgcatggcagaacccgaaagtcgcgactctctgcttcggctacaagttcgcgttttaa

SEQ ID NO: 2174 - DNA, 633 bp, Alistipes sp.
atgaaaaaagtaatagtgtcgctgattgtgtcccttctggcagccatgcttgggatcgtgggtctgaacctattcaaggacgcaggcccacgggaaaggatgaaggccgagaacggcagcaggataatcgtggaggaacttagtttctacaggcacggtgacaaggttttcggcaagattttcaagcccaccgacgagaatggcttcttcccggactccctcgggccgaggcctgtcatcatcttcttccacgaaccgctgaagaccgcctatcctgaagggcttctgaagtccctggttcccgaagggttgataggctactcgacagcattccacgagagaggcaacgatgtgagattcatggtgaagaagataaggaaggagaagttcgccgatgcggagagaataatcctgatagcggacacattctctgccgaggccgtgacaaaggccgcctacaggcttaagaaatccgtcagcggtctgatcctgatagagccggaggtcagcgagagcgtctcgcgcctgacgcccaaacttggctacgaggtcctgaccgtcagcacgacagaaaagacttccgcaaggataaagatccttgattatcttgagatcagaggagcgttgaaatga

SEQ ID NO: 2175 - DNA, 426 bp, Alistipes sp.
atgagacacgagatcatcataaaagacctgcaggacattgacagagccgcgggcgagttcctttcccggacggaagggcacaatattcttgcgttctacgctcctatgggggcgggcaagacgacattcactacagcggtgtgccgccgcctgggagtgcgcgaggacgctgtcagctcaccgaccttcgcgattgtcaacgagtaccgcaccggctccggcgaaccgatgtaccattttgatttctaccgcattaccaagatctccgaagcgctcgacatcggtttctacgactacatcgacagcggatgcctctgcattatggaatggccggaaaacatcgaggagatccttccggaagagacgctccggatccacatcaccgtcaatccggacgagtcccgcaccgtttcatgggaggactga

SEQ ID NO: 2176 - DNA, 828 bp, Unknown
  Description of Unknown: Ruminococcaceae sequence
atgacacaggaaaaactggaacagctgaaagcgaccgccacagaggtgcgccgcggtattctgaccgaagttcacgccgccaagtcgggtcatccgggcggctcgctttcggtcgcggatattattacctacctgtacagcgaggtgctgcgggttgaccccgaaaatccccgctgggaggaccgtgacagattggtgctaagcaagggtcacacctgcccggcgctgtacgctatgctggcggaaaagggcttcttccccaaggaggagctgaccaccttccgcgcgatcggttcccgtctgcagggccaccccgatatgaataaggcccccggcattgatttttccgccggttcgctgggccagggcgtcagtgccgcctgcggtatggcgttggccggtaagctggggcacaaggactaccgcgtctataccattctgggcgatggcgaaattgaagagggtcaggtgtgggaggccgctatgtttgccgaccactacaagctggataacctttgcttcatcatcgataacaacgatctgcagatcgatggccgtgtgggcgaggtttcttctccctaccccatcgatgaaaagtttcgtgcctttggttttgaagtattctgctgcgatggccacgattttgccgcgctggaggagacattccaaaaggtactgaaggtgaccggcaagccggcagcgatcattgccaagaccgtaaagggcaagggcgtcagctacatggaagaccaggtgggctggcacggcaaggcccccaatgacgccgagtacgaacagggcatgaaagagctggaggaggtgcggtaa

SEQ ID NO: 2177 - DNA, 966 bp, Unknown
  Description of Unknown: Ruminococcaceae sequence
gctcgtgtcggcggctccgccgccgggcctgcggccttcgcccccgctcgtccatcccatttgatgctaaggagaaaacaccccatgaaaaagcttctgtttatcatcaatcccatggccggccgccagcaggcccaaaccgacctctacaaaatggtcaagatcttcgccgaccacgattacgaagtcaccgtttaccccacccgcgcccggctggattgcacccggaaggtgctggaggacgccggccggttcgatctggtcgtctgctgcggcggcgatggcaccctcaatgaaatggtcagcggcatgatgcagcggcaggaccgccgccccatgggctatattccgctcggctccaccaatgacctggccgtcagcctgcggctgcccacccgggtggaggaagccgccctgcgggccgtcaccggcaatgagttccatatggatgtcggcaccctcaatgaccgctatttcaattacatcgccgccttcggcgcctttaccgaaaccagctacgccaccccccaggagatcaaaaatgctctcggccacctggcctatattctggagggcgtcaagagcctgggcaagatcctgcccatccatgtcaaaatcaccgccgatgacgagcagtttgaggaggattacctcttcggcgccgtcaccaataccatctccctgggcggcgtcttaaagctcgatcccgaaaaggttctgctggatgacggcatgtacgagctgcttttggtcaagaatcccaccaatgccctcgaagcgcaggccatgctcaccgccataatgacccaaaattttgatggcccgctggtcaaaatgttccacgcctcggatatcaccttcgaatccagccacgagatcagctggaccatcgatggcgagtacggcggcaccttcagccatacccacattctcaataacaaaaacgccgtgactctcatcgtataa

SEQ ID NO: 2178 - DNA, 777 bp, Unknown
  Description of Unknown: Ruminococcaceae sequence
atgagtgcattgctttctttgcggaatatccacaccggatacggcagcagagaaattgtccgcggtgcttcccttgcggtagaaggcggggaattctgtgcgctgctggggctgaacggctgtggcaagaccactctactgcgcgccgcctgcggtctgctgccgatgaaagagggccgttgtatggtgggggagaccgaaaccacccatctggacgaaaaaagccgcgcccgcctgatgagctatatcccgcagcgcggcagtcctatcatgggtaaaaccgtgctggaggtcgtcctgatgggtttcaacgcccgactgcgtcttttggattcccccggggaggcacaccgccgaattgccatggaacatctgacccatttgggactggcagaactggcagggcgggactatgctactttaagcgaggggcagaagcagctggtgatactggcgcgcgccctttcgcaggatacgccggtgatgctgatggacgagccggacagcgcgctggattttgtcaaccggcatatggtgctggggaaaataagagcggtgctgcatgagcggcagcaagcggggcttatcaccctgcatgaccccaactttgccctaagctactgcgaccgcctgctgctgatgcaagacggcaccatagtgaccgaaattgatatgagaaataccgaccgtgcgacgatagaagcggcacttggtataatatacggagaaatagccgtgttggagtataaagaccgttatatcatgaccaggcgatga

SEQ ID NO: 2179 - DNA, 1983 bp, Unknown
  Description of Unknown: Ruminococcaceae sequence
atgagcgaggacattcgccgcaaaatgcgggagctggaaaagcaggttgaacatcatatgcatctgtactacgacttggatgcgccggagctggaggattatgagtatgatcgtttgatccacagcctgatggacctggaggagcaatacccgcagtacgcttcgcccaattcgccgaccaagcgggtgggcggtaaggcgcagaacaccttccgggaggtcacgcacaaagtgcagatgggctcgctgcaggatgtattttctaccgatgagctgcgtgcctttgacgcgcgggtgagggaggaagtgccgaaccccacctatgtggtggagcagaagatcgacggactttcggtttcgctggaataccatgatggggagctggcggtgggatctacccgcggtgatggttttaccggggaggatgtgaccgaaaacctgcgcaccattcgcagcatcccgctgcagttgccggaggcgctgccgctgctggaagtgcgcggtgaagtgtatatgcccgtgacgagctttaaccggctggtgcgggaacaggagctgcgggaggagataccagcgaagaacccccgcaacgcggcggctggctcgctgcggcagaaggaccccaaaatagcggcggccagaggactggatatcttctgctttaatgtgcagcagctggagggtgtgacctgtgagcggcacagtgagtcgctggagctgatgcggcggctggggttcccggtttcgccggattacaaggtatttgataacatagaggacgctataaaacaggtggaagtgataggcgagctacgcggatcgctgggataccagatcgacggcgcggttataaaggtggaccgctttacagatagagagcttttgggcagcacagccaaatatcccaaatgggcggtggcctttaagtatccgccggaggaaaaggagacggtactgcgggatgtggtgctgcaggtgggacgcactggcgcagtgacgccgaccgcggaatttgacccgatagagctggcgggcaccactgtgagccgagccaccctgcataatcaggattttatcacccagctgggggtgaatatcggagataccatcgtggtgcggaaggccggggatattatcccagaggtgatagcggtaaagaaccacccggaagggacatccgcctatacactgcccacccattgtccatcctgtgggacactgctggtgcgcgatcctgaggtggcggctatccgctgtcccaatatcagctgcccggcgcagatactgagaagtttgatccatttttgcagccgtaatgcgatggatatagaaggactgggagaagcggtgtgtgagcagctgcttgcgactggtttggccaagacaccggccgatctgtaccggctgaccaaggaagaactgctggggctggagggattccagaagaagaaggcggagaatatcctttcggcgctggaaaaatccaagcacaatgagctgggtgcgctgctgtttggcctcggtatccgcaatatcggcgataaagcggcgaagttgctggcgcagcggtttggttccctgcaggcggtggaagcggctacgaaagaggagctgctttccattgaaggctttggtgagatcatggccgagagtgttttgcaatactttgacgatgaaaataaccgtcggttgtgccatgatttgctggcccttggtatggagccgtgggtgccagagcagcaatcggccgctttggcggggatgaccatagtagtaaccggcacattgccgaactattcccgtgaggagatccaggatctcattgagaaaaacggcgggaaggcctccggcagtgtgagcaaaaagacaagctatgtagtggccggagaagccgcgggaagtaagttgaccaaggcgcagagtctgggtgtgccggtactgacggagcagggattactggaactgatagaaaggggttcttaa

SEQ ID NO: 2180 - DNA, 558 bp, Unknown
  Description of Unknown: Ruminococcaceae sequence
atgcaggaattctatgatatcaccgtggcaggcgtcaaacgcagtctgccggtcgtccccatcaatgaaaacatgtccattgccggctttgttatctttggcgataccgatgttgtagagccctgtgcccgtgccctggcggaaaagctgccccccgagaccgaggtgttggtgactgctgaggccaagagcattccgcttatttatgagatggctaaagtgatgaagatgccccgctatgtcattgcccgcaagtcggtcaagggctatatgcgtaatcccatcatcaccaccgttaattccatcaccaatatgggtaaggagcagatcctggtggtagatgagcacgatgccgagttcatcaagggcaagaaggtcgccatcattgatgatgtgatctccaccggcagcagcattgaggccatcgaaaagctggtgaaggaatccggcggcgaagtaattgcccgcgcggcagtgctggcggaaggcgatgccgcggaccgcaccgatatcatctatctggaaaagatcccgctgttcttccacaataaaaagtga

SEQ ID NO: 2181 - DNA, 1173 bp, Unknown
  Description of Unknown: Ruminococcaceae sequence
ttggccgaaaaaaagcgtgccgcacgcaaaaaaccgcaggagggcttcttccgccgcctgttcccccgatatgagaataccagtgtggacctcaccttcttggtaatggtcattctgctgctggtatttgggcttgtgatgatgtttagcgccagctatgcgcagggctattaccgcgaaggcaacagctaccactacattgtgcggcagctgctgtgggcggtcgtgggccttggggccatgtttgttttttcccgcctggattaccatgtgtggcgcaagctggcctggccgctgttcccggtggtcaccgccatgcttatcctgtgctacttcatgccgccggtcaatgacgcccatcgctggattttcatcggcagtttccagtttcagccctcggagctggctaaattctcactggtgctgctgttttcgcacctgcttgtttccaatgaaaaaaagctggggcggttccgctacggtattttcccctttgcggtggtgctgggcgtttatgccggcctcatcgtaaaggaaccccacctttccgccaccattctgttggtggtgatgggcggtatcatgctggtggtgggcggcctgcccatgaagtggatcgccgccgcgggaggcattgccgccgcgggtgtcgccgccattatgctggtgccctcgctgcacgagcgcgccatggagcgtatcaccatctggaagaatccggcctctgatcccttgggcaccggctatcagatcctgcagtcgctgtatgccatcggctccggcggcctgatgggctccggtatcggcaactcccggcagaagtacctcttcctgccggaaccgcagaatgactatgtgttctcggtcgtctgtgaggagctgggcttcatgggggcactggtggtcattgtgctgttcgcccttctcatctggcggggctttaccattgttattaaggcccgcgatcgcttcggcgccatgctggtcaccggcttcattgcccaggtgggggtgcaggccatccttaatatggcggtcgtcaccaataccatcccctccaccggcatcagcctgccgttcttttcctacggcggcacggcgctggccattctgctgggagaaatgggcatcgtgctttcagtctcccgccaaacgacagtagaaaaggagtaa

SEQ ID NO: 2182 - DNA, 540 bp, Unknown
  Description of Unknown: Ruminococcaceae sequence
atgcaggaaaaggacctgctgcagaaagcgatgcagcaaaagaacatgatggtgctgtaccgggatgagctggtggcgccggaatatgccggggtgccggtagcggtggaaaacgagctggtggtgctgcagcggcagacgaactttgtgctggatggctactgcgccctgcgcaccggggatattaccgaggtggagcagatggacgatgtgccgttcctgaaaaaggtgatggccggagagaagctgtacgacgccgtaaaggcgccgggctttgcctgccgcggctggcaggagctgctggagggcattatggcccaatacggcggctgggccgcggtggaatgtgagggcaacccggaggaatcgctgtacttcctggggcggctgatgaaggtagacagccgctacctgaccatgaagcgggtggacgcgctgggcaactggctttctgatccgctggtgctgccgctggacgatgtgacactggtttcctttggcgaccggtatttggagatcttccggaaatactgcaagtga

SEQ ID NO: 2183 - DNA, 687 bp, Unknown
  Description of Unknown: Ruminococcaceae sequence
atggcatgggcttgcattttacgaggtatagcggtatactattggcggaataaccgttctgaaaatacatttacaggaggtattgtgatgaatcatattgacgcaaaaggcaaggcctgccccatgcccgtaatgatggccaaaaaagagatggataccggctgcgaggcgctttccatcacggttgataatgccatagccgtacagaatctgagccgcctggcggagagccagggctttgccgccgagaccgccgaggagaacggctgctataccattaccatgcatcgcaccggcgcgccggcccaggagatgcctgaggagctgctgaactgcgctgtgcccgccgcgagcgactatgtggtatttgccgggcgggatgtcatcggtgagggcgacccggagctgggccattccctcatcaagatgttcttctacaccctgagcgagaagcctgacctgccttccgccatctgctttatgaacaacggcgtgcggctggtgactgagaacgagcagaccatagagcacctgaaggtactggaagcaaagggcgtcaagctgattgtgtgcggcacctgcctgaatttctacgggctgaccgacaagctgcagtgcggcaccatcggcaacatgtatgacattgtggagaccatgaccaaggcgggcaaggtcatcaccgtgtaa

SEQ ID NO: 2184 - DNA, 909 bp, Unknown
  Description of Unknown: Ruminococcaceae sequence
atgggattttttgatattttccgcaaaagcgtaaaaaagaccaagcagagcctgagcctggagctggatagtttctccgggaagatcacctttgataccctggaggagctggaggagatcctcatcctggccgatgtgggtgtgaccacagcgggcaagatctgctcccggctgggcgagcgcatcaagcgccggaacattgattccaccgagctgcgggagaatctctgcgagatcgtgaccgagctgatggagccggatgagccgctggtgacggagaccaagcccagcgtggtgctggtggtcggcgtcaacggggtgggcaagaccacctccatcggcaagctggcctattggctgcagggccagggcaaaaaggtgctgctgggcgcggcggataccttccgggcggcggccggtgagcagttgggcgtttgggcggagcgggtaggctgccagatgataaagcacgccgagggcgccgaccccgccgcggtggtgtatgatagcatcaccgccgccaaggccagaaatgtggatgtgctcatctgtgatacggcgggccgcctgcacaccaagaaaaacctgatggaggagctggcgaagatcgaccgggtactggagcgggaagcccctggctgcagtcgtgaaacactgctggtgctggatgccaccaccgggcagaatgggctgaaccaggcgcgggaatttgccgcggcctgcggcgtcaccggcatcatcttgactaaactggacggcactgccaagggcggtgtggccatcgctatccgggatcagctggggctgcccatcaagtttgtgggcaccggcgagagcattggggacctgacccccttcagcgctgcagaatttgcccaggcgctgctgctgaacgaggacgaggaatga

SEQ ID NO: 2185 - DNA, 693 bp, Unknown
  Description of Unknown: Ruminococcaceae sequence
atgacaacggagcgaaggagaaacgctccggaaaaaacaagcgaccttttgcagaaagggcaaacaaaaaagaaaggaagaagcttaaattatgaaaagcaaaaaatcttggtagtactgatggccgcgctgatggcactggctatggtagcctgcaacaacaatgaaccggccccgacccctgatcctgagccgacccccgaccccgcgcccaccaccaaggtggattacagcggcagcctgactgactggatgtacacccccgagaccgaggatgagctgaccaagctgctggtctccatcgatgaagtgagctacggcagcgcgggcgccagcctgcagcaggccaacgcggcggtagccgtgatgaagctggcgatggatgagagcggcaaggcccaggagaccgtaaaggcttatctggaggggatgaacgagacccagaaggattacttctccttccagtggcagcaggccatgaagaccgcgctggccctgctgaacggtgacgaggacgcggcgatcctggaggatgccggtgatgcggactttgacctgaaggccgtggacagcgccaagaccgcagagtttaatgacgccgtgatccagctgctgagcgatgcgggtgtgaccaacgaatggaagaaccacaccgatgtggagcctttcctctacgccacagccataaaataa

SEQ ID NO: 2186 - DNA, 1032 bp, Unknown
  Description of Unknown: Ruminococcaceae sequence
atggagctggatcccagaaaaagcaggatccttacctgcgtggtggaaagctacatccgcaccggcgagcccatcggctccaagatgattgccgccatgctggaggagactgtctcctccgctaccgtccgcaatgacctggcctacctcagcgagcagggctacatcgagcagccccatacctccgccggacgcatccccactcaccgcggtttgcgctactacctcgatcacctgatgaagccgcagccgctgggggacgccgcccgcggcgagattgacgccctgttcaattactgcgaccccgaccccgaccgcgtgctggaaggcgccacccggatgctggccaaggaaaccggctgctatgccctttccaccaccatctcccgccagagcctctttgtcaagcgcattgagatcattccggctacggcccacaccgtcgttatcctgctgctgtgcagcaatggcatggtgaaaaacaaggtctgccgggtcaatttcaatctgacccccaatgtggtggacttcttccagagcttcgccaatggccgcctggccgggcgcagtctcaatgagatcaccgcccagtacatcaattcgatggcctttaccctgggtgagcacaccgatatctttgcgccgcttctggccgctatttacgagctgtgccgggaagcctgcgaaggtgccctgtaccgcagcggcacggggaatctgctggaacacccagagctgagaaatgtggccgaccggctgtaccgcctgctagattcccgcgaggaaatgctgcggatcattggcagccgggaaaatgacctgtttgtcagcgtggggcgggaaaatgcccgccccgaaatggagaattcctccatgatcgttgcccgttaccgcatcggtgaggattccatcggcgccctggggctggttggccccgtccgcatggattacgcccggctcatcccccatgtggagtactttgccgggatgctgagccggatgctgagcgatacactgaataacggtctgtaa

SEQ ID NO: 2187 - DNA, 1560 bp, Unknown
  Description of Unknown: Ruminococcaceae sequence
atggaacgctacgccgtcgatttcggcaccagcaataccgtggtggcccgctggaactttgccagggaggagccgcagaccatgagcttcccggccatcaccgcgccggggagcggcgccatgccgccggtcaccccctccgtcctctactaccggggggaggaaagcttcctaatgggctacgaggtcacctcccgcgggctggatgatatccgcagcagccgctatttttggggcttcaagcggggtcttctgcacctcacctccctctacgaggatcgcggccgggagttttccgccgaccatatcgcgcggctgtatctcacccggctgctgggcaatttggagctgaacgccgataccgtggtcacctttaccgccccggtcaatgcctttgatacctaccgggagtggatctccgccttttttgcggaaaattaccccgatgtcccttaccgcctggtggatgaatcggtggcggccgccatttcctacggctctacccgggccggttcggtggtgtgcgtggtggattttggcggcggcaccctggatgtttcggtggtccgcatgccggaatcctttgccggggcggcggccggagaagcggccaagggccgggtgctgggcaaagccggcgccttcctcggcggcgatgatatcgaccggtggctgctggaggatctgctgatgcgggccggccgcaccgccgaagagtgcgaggagatcctgccgcagcttaccaccctggcccggcagatcaaggaggagctttccgctcaaagtgagagcagccgcagcttttttgatgccgagcatttcaagacctacgagttccgctacacccagaatgacctgctggatcttctggaggagcacgatttttttgtcaccctcaatgatgtcctcaataacgccgtcaacatggcggaagccggcggcatttcccgcagccagatcgagcgggtgctgctggtggggggcactaccctcatcccggcggtgcagcggggcatccggggcatctttggccgggaaaaggtgcagtgccacaagccgtttgaggcggtggcccacggggcgctggccttctcgctggggctcaatatcgtcgatttcatccagcattcctacgccatccgctacctggattccctcaccaaggagccgcggtacaagatcatcttcaaggccggcagcgaataccccagcgaaaagccggtgaccctcaccctgtcctcctccttccgcaatcaaaaggcgatcgagctgatgatggcggagattgagcacaagcggatgggacgggtctcctttgatgccgatggacggttttctgcggtggatgacagcagcgataccgtgcggctgctcaattacagcaaaaattccgccaatgccgccgtcattgccaagctggagccgcccggcaccccgctggataagcggctgaatgtggccttttccatcaatgcccgcaaggagctgaccgccaccgtgcacgataacctcaccggtcaggatatctatgtggatatgccgctggtggcgctgcggtaa

SEQ ID NO: 2188 - DNA, 1035 bp, Unknown
  Description of Unknown: Ruminococcaceae sequence
aaagatagggaaaacccgcacctgacgcccccgactgtacgacgaaaaggacaggggcgcgagctgccggctttgccgaaaaaccggacgaaccaccaaaggagtgtgagggacattatgaaaaaggcaaaaaagaaccgtgatcgtgcggcgcttaattcaccgctgatccggcgaccgatccagaaatgcttctggctgttcctgctgccgaccttcgcagcattctgcatcggctttttgtatccgttctgcaagggattcttcctttccttctgcgattttaagaccaccaagaactggacatgggtgggcattaaaaactacatcgccgcatttcaggataagagcttcggccatgccttctggtacacggcactgtttgccgtggtatcactggtgctcatcaatgtcatcgcctttgccattgcctatgcgctgaccagagggatcaagggctccaacctgttccgcaccgtgttctttatgccgaacctcatcggaggtattgtgctgggctacatctggagcatgatcttcaatggtattctgatcaaatacagcaccagcgtggtattggagtccaaatacggcttctggggcttgatcatattgatgtgctggcagcagatcggttatatgatgatcatttatgtggccgggctgcaaagcgtgccggaggatatgctggaggcggcgcgcatcgatggcgccaacggctggcagacgctgtggaagatcaccattcccaatgtgatgccctccattaccatctgcaccttcctgaccctgaccaattcctttaagctgtacgaccagaacctggcgctgaccgccggcagaccctttatccagcagggcggcgaggtcattaagaccaccgaaatgctggcgctgaatatcgttaactccttctacgccagcgcacgcagccgcggcgtgggacaggcaaaagccgtcatcttctttgtgctggtggctgttttgagtatcctgcagctgcgttccacccgagagaaggaggtgcagcaataa

SEQ ID NO: 2189 - DNA, 663 bp, Unknown
  Description of Unknown: Ruminococcaceae sequence
atggcatactggatgacacacctgcgggtagcggaagctctgctgcgctgcctgccggaggggatctccctcccccattattacgccggttccattgcgccggattgcggccgcaccgagtggaatgaggacggtacaccgcgttatctccctggccgggtggtgacccactggctgaagaaggatgaagcactggaccgctgcctcattgattttgagggcttctacaatgcaatgatgccccaggcggccgatgatggggcccgtgccttctactggggatattatatacaccttattactgatgccatgtggcaggaacgggtgctgcgtccccgccgggaatcccttgcggatccttccaaggagaacatttccgccatgcgggccgatctgaagctggccgatttggccgattatcgggaaaatccccactaccctccgctggagatcctgcgcaataccccctccttccccaaccgctacctcgactactacaccgaggacgacattgaaaaccaggtgcatggcatcccccagcgcctggcagaggaagccgccactgctgaggaaagtctttggctttccccggaggagcgcgatgagtttattatgtttgccaccgccaagtgcatgcagatggtgcgtgcccacctggcttaa

SEQ ID NO: 2190 - DNA, 1770 bp, Unknown
  Description of Unknown: Ruminococcaceae sequence
atgtcaggcggggaaccgagcagcattaagcagtatttgcgggtgccgcagccaaccgggtttccgtgtgataaaggttgccttttcattttgcgggaaaggggagaaaacggaatgtaccaggcactgtaccgaaagtggcgtccccgcacctttgaggaagtggtggggcaggagcatatcaccaccacgctgaagaacgagatgatccaggggaagcctgcccatgcttatctgctgatgggcagccgtggcaccggcaaaaccacctgcgccaagctcatcgccaaggcggtgaactgccgcaacccggtggatggcagcccctgcggccaatgtgactgttgccgcggcgtggataacggcagcctggtggatgtagtggagattgatgccgccagcaataacggtgtggataatatccgtgacctgcgggaggaagccgtttttctgcccaatatcgcaaaatatcgagtctatatcatcgatgaggcgcatatgctttccgtcggggcggtcaatgccctgctcaagatcatggaagagccgccggagcatgtgattttcattttggccaccactgaggtgcacaagatcccggctaccattcagtcccgctgccagcggtttgattttaagcgtattgcgccggaggtcatccgggataggctgcttttcattgccgggcaggaggacatgaccttgacggaagaagccgcggctctcattgcccgcattgccgatggcggtatgcgtgatgccctttctctccttgatctttgctgggcacacgcccatgatatcaccgtggagaccgtcagcgaggcggccgggcttgtggggcaggattatctttttgagatcgccgatgccgccgcgacaggggattttaccggcgcaatggatgccatggagcgcctggccggacaggctgtggaatatgaccgcctgtgcagtcaattaatcagccattaccgcaacctgttggtggcagctaccgctcgcgatcccgaacaacttattgtctgcctgccacagacgctggaacagtataaaaagcaggcggcttcctttaccccggccgcgctgatggatgccatcagaacgctgcaggatacccaggccgctatggctcgcagcaccagccgccgggcggagatggaactggctctcttaaagctcagcgaccggcgggtaagccccagccgggaagcgctggtcgcccgcatcgaggagctggaagccaaactcaaccgtttgttggcggaggggatccgccccgctccggctccggcgcagcagtcggctgtcggaggaatgttccagccacaacaagaggaaccggccgaaccggagcaggtagcgctgccaggcatggagctgcccccgcagcaggaggaagcagccccaccggctgcaaagcctgccgctaccccggtggagccaatgccggaggatcagtggctgcaggtgttggatcgccttggcgtcatcaataagatgctggcaggtgccctgcaaagcagccatgcccatttccgcgggcagactgtccttatcgagtgtgataagcccatcttcctggagatgatgcgcagcaatgacttcactcgtcagagcctaaagcgagctatcgccgaagtgaccggtgtaaaatacggtgtggggccttacaccgctgcgcccaaggcaaccaccccgcagagctctccgttggaggatctcatcaagcaggcagagggaatgggcatcccggttaccagagaataa

SEQ ID NO: 2191 - DNA, 732 bp, Unknown
  Description of Unknown: Ruminococcaceae sequence
ccgcacaaaccgggagtgcgctgcggcgctgagatgggcaaaagcccgaatccctattacctgatccggatcataccggcggagggagcgtttaccaaagcggagcttttccgctgcttctttgccggatcgtccatcagggacgatctcatttttttggaggaaaactgtatgaaaaaccaaaacacacgccggctggtggagagtgctttgatgatcgccatcggcacagtcctttcggagctgaaggtgggcagcctgtgggcctttggcggtggcctgaccatcggcagcatggtaccgctggtactgatcagccaccgctggggcattaaatggggcacctttaccgcctttgtttacagcctgctgcagcttatcctgggtgtggataatgtgcagtacgccaccagtgtgggcatggcgattgccattatcctgctggactatatcattgcctacaccgtgatcgggctttcttcaatgttcggctccagtcggccggccatcattggcggtgtggtggtgacgctgggactacgcttcctgtgccacttccttaccgggtggatgatctgggatgcgctgtggcccaacgagtttggcatgacctccgcggtgtattcgctgtggtacaatggctcctacatgctgccggagatcgtgatcaccgcgatactggcctgcattctggtgccgtggctgaacaaagccttccccgccaagaaataa

SEQ ID NO: 2192 - DNA, 1224 bp, Unknown
  Description of Unknown: Ruminococcaceae sequence
gtgcccgtcggtttcggctgtgccgaaacagcctgcggcccggtgccatccctcagcagaaattcgcccagacgacctggcgggagtgaaaacttcccccttggcagttggccgttgatgcggtacaataataggcagaaacaaacgaaaagtgaggagcaaccaatggtctataagcacttttttggcaggacaccggaaggacaggcggtaacacgcttcaccctgtttaaccacaataccatggaggtgaatctcctcaattacggggcggctgtgcatagcatctgtgtgccggataaagagggcatggtggaggatatcaccttggggtgtgataccattgcagattacattgaggccccgcactttggcggaacaataggccgggtggccaaccgtattgccggggcaaaattcaccctaaacggcaaggagtatcagctggcggccaatgacggcggcaaccacctgcacggcggcaagcgaggctttgacagctgcctgtggcaatggagcaccgaggacattgataatgtggtggtgttctcccgtacggcagaagcaggtgaggagggttatcctggcaaactgcatgtggaggtgcgctactgcctgacccaggaggatgccctcattatccactatactgccacagcggaggagggggacaccctgctgaacctgaccaaccacacctattttaatctggcggggcagggcaagggggatatccttggccaccggctggagctggcagccagtcgatataccccggttaatgcggaactgatccccaccggggagatgctgccggtggcgggaacgccgctggattttaccacgccacataccatcggggaacgcatcggggcagactgtccgcagctaaaaaatgctggcgggtacgaccacaatttcctgttggactatgatgccgagagcctaaatccgctgcacccggcggcggagctcagcgaccccgtaagcgggcggcggctcaccgtcttcaccacagaaccggccttgcagctctattccggtaattttctgtgtggagagcggggcaaaggcggcattgcctaccagaagcacagcggaatctgcctggaaacacagcattgccccgatagcccccatcacccgcagtttccctccatcctgctgcggcagggcgaaacctatgaatccgaaacggtgtggttctttggcctgaccgagtga

SEQ ID NO: 2193 - DNA, 870 bp, Unknown
  Description of Unknown: Ruminococcaceae sequence
atgaaccgaactgaccgtcctgcccgctgtgccgctgtgcacgatctttccggcctgggccgctgctccctttccgttattctgccggccatgtcggtaatgggggtgcaggtgtgcccgctgccgactgcggtattatccacccacaccgggggctttggcaccccggcccgtcgcgacctgaccgactacctgaccgaagcgctggcgcattaccgtacactgggtctgcccatggagtgcgtctacaccggctatttgggctcggtggcacaggttgcgctgtgccaggggctctttgcggaatggcccgcggccatgaaggtggtggaccccgtgatgggcgaccacggcaagctgtaccacggctttacgccggaactggtacagggtatccgggagctggccacccatgccgatgttatcacccccaacctgaccgaagcagcactgctgctgggtgaggagccgaatacggcccccctttcgctggggcaggcccgcagcctgctggcacggctttcggccctggggccgggggtagtggttatcaccggggcagcgcttaccaccggggaatatgccaacctgtgttatgatcgggaacgcggcggctactggaaatcggtaagcgaatacctgccggtgcgttatcccggcacgggcgatctgtttgccgcagtgctgacagccggcctgatgcagggcgacagccctgctatggcgatggaccgggcaacgaggtatgtggagatcaccgtaaaaacgacctttggttacggcgccgattctcgcgagggagtaatgctggagcgcacactgggctggctgacccaaaaggagctgccgcgaggctaccgcacgctgtaa

SEQ ID NO: 2194 - DNA, 546 bp, Unknown
  Description of Unknown: Ruminococcaceae sequence
tgctggcgggaaaatggagagagtatgaactacgcgagtatcaaaaactgcgatattgccaatggtgagggggtgcgggtgacactctttgtcagcggctgcaccaaccactgtgaaaactgcttccagccggagacctgggactttggctatggggagccctttaccccggcggtggaggaccgattgatagagatgctgcggcccggttttatcaatgggctgacgctgctgggcggcgagccgatggagccgcagaaccagcgggcgctgctgcctttcctgcggcgggtaagaaaagagctgccggagaaaaccatctgggcgtttagcggttttacctgggaggagctgaatacccccggcagtcacccttgctgcgaggtgacgccggagctgctatccctgctggatgtgctggtggacggacgctttgtgcaggcgctgtatgatatctccctgcggtttcggggctccagcaaccaacgcattattgatgtgccaaagacgctggagagcgggaatttgacgctgtggcagggataa

SEQ ID NO: 2195 - DNA, 579 bp, Unknown
  Description of Unknown: Ruminococcaceae sequence
atgaagaaatttctcaaaaagtacggctacattctattggtagtagtcattgcggcggggtgctataccggtttccgggcattccggtattactaccatgatacggatgactactgtctgcgcacctacggtaccatggcaagggtcgaagaaaagtgtgggaaaacagggctgctgcatatggaaaatgccgggaactggagcagccatgactattggctgaaataccccaaggatgaaccggaaaacccggaggatatcacctgctactatgactggagaaaagagaaccacaccgtttatcaggtcgattttcataagaacggcgtgacccttgaagaatacatggggcgctatcaccaggacccgccggagggctccggccagtataccgatactgatttgtggaccgatttccctgtgccggtgtactacgatgtaatcgtttacccgcatacctacgagcccagcggctacgccttcttcgagtatggcgatgcttattaccgcatctctgtcagcagccgcgaggaagcccgtaccgtctgcgcggcgctgttcgcctccgccgaaagctga

SEQ ID NO: 2196 - DNA, 834 bp, Unknown
  Description of Unknown: Ruminococcaceae sequence
tatgaacgccttaaaatgctgcatggcattttccacccggaggcccgcccggagggcgggcggcctgcggcccgatgcccggattctgcaggaagtggacgaggacggaaagggggatgtgccgtgcgcagagaactgtgggtggatggtaccgacctgagctatgagtggcagaaaaagagggtgaagaacctgaacctgcgggtgcggccggatgggagcatccatgtttcgacggcggggtgggtgtccgcggcagcggtggatgaatttgtgaggagccatgccgggatgatagaaaaggcccggcaacgctggcaaaacgagcgtctgcaggaggccctgacggtagagaatggagcgaagctgccctgcttgggcagggagatggagctggtgctgcggaagggaagccccaaaggcgctgagctgcgaggaaaccaattggtgctgacgttgcccgacctggccgaccgaaaggcggcggaacggctcctgacggggtggtggaagaaaatctgcggggagctttttgcggcggtgctggagcagtggtacccccggtttgcccggtggaacatccccaggccgatgctgcgcacccggcggatgaccagccggtgggggagctgtcagccggccacggcggtcatcacgatgaatgagcggctgttgcacgcccccatggaatgcaccgagtacatcatggtgcatgagctggcgcacttggtgcgggcggatcattccccggcgttccacgcggtggtgaccgaggtgatgccggactggaaggaacgcaaaaagcggctgcgggaggcgaagatcccgctataa

SEQ ID NO: 2197 - DNA, 675 bp, Unknown
  Description of Unknown: Ruminococcaceae sequence
atggtcacagaaaggagcgtggcgaaaatgcaggaaaaagaacgcattgcgcacatcatctcagaactggaaaagctctacccgcaggatctttgttccctgcagtatcgcatcccgcacgagctactcattgctgtacgcctttccgcccagtgcaccgatgcccgtgtaaaccaagtggtacccgccctattcgccaagtacccctccattgaagcctttgccgaagcggatgtcgccgatgtggaagaaatggtgcgcagctgcggcttttatcacaccaaggcccgcgatatcgttgaaatgtgcaaaatgcttcgggatgaatacggtggcgtagtcccggattctattgaggaactcacccgactccccggcgtcggccgcaaaacagccaatctcatctgtggtgatatctacggccaaccttcctatgtttgcgatacccactgtatccgtatcaccaatctgttgggtcttactacttccaaagacccctacaaggtcgaaatgcagctgcgggaaaaaatccccccggaaaagtccactggcttctgccaccgtatggtgcttctaggccgggaatactgcattgcccggcgcccacagtgcatccgttgccccctgcggccctattgccccggccaaacagccgaaaaaattaaaacatcctga

SEQ ID NO: 2198 - DNA, 1152 bp, Unknown
  Description of Unknown: Ruminococcaceae sequence
gacaagagaggaataaaaagaatgtatcaactgaaactgacagaaggagcagcccggcggggagcgcttaccaccgtacatggtacggtgcagacgccggcctttatgaatgtggcgacggcggctgccatcaagggcggtatttccgcttatgacctgaaggagctgaagtgccaggtaatgctgtgcaatacctatcacctgcatctgcgacctggtgataatgtggtgcgtcagctgggagggctgcacaggtttaccggttggcagggacccatcctgaccgacagcggcggcttccaggtgttttcgcttgcatcgctacggcatatcgaggaaaagggagtgacctttgcctcccatatcgatggacatcgtatttttatgggaccagaggagagcatgcagatccagtcgcatttgggttctaccattgcaatggcatttgatgaatgtatcgaaaacccatcgccccgggattatgtgcagaaatcggtagcacggacgacccgatggttggagcgctgccaaaaggaaatggcccggctgaacagcctggaggatactgtgaatccacaccagctactgtttggcatcaaccagggcggcacctatgaggatattcgggtgcagcacatgaaggatattgctgcgatgggattggacggttatgccatcggtggactggcagtgggcgagagcgccgaagagatgtatcatatcattgaggctgtggagccctttgccccgaaggataagatccgttacctaatgggtgttggtacacctgtgaatatcttggaatcggtacaccggggtgtagatctttttgactgtgtgatgccaagccgcaatgcccgacatggccatctttttacctgggaagggatcattaatatccaaaatgctaagtatgtaacggatgaccgcccggtggatgccctttgcgggggcccactgtgccgtaaccatacccgcgcctacttgcgccacctgatgcgtgccaatgaaatgcttggtatgcggctggctgtgatgcataacctgtggttctataatacactgatggaagagataaggttagcactggatgagggacggtttgagagcttctaccgcgagtatgtgccaatactgggtaagagaatataa

SEQ ID NO: 2199 - DNA, 2043 bp, Unknown
  Description of Unknown: Ruminococcaceae sequence
atgagattttttgcgtggaaagaaaactttgccaaagcggacgcgctgatcgttgagaaccggcctctgccgatgttcctgtgccgggtgttggcttcccgcggaatcaaggattccgcatcagcagaaacctttttgaactgtacccaaccgctgtgcgaccccatggaactgcatgatatggaaaaagcagtgacgattgtgcgcagggcgatagacgagggaaagaaaattcttgtctttggcgactatgactgcgatgggatcaccgccacggtgttgctgtatgagtacctggagggcgaaggtgctgatgtgtgctattacatcccggaacggctggatgagggctatggtctttccatgaagacgatggaaatggtcatttcctctggaatcgagctgatcatcactgtagataacggcatttctgctgtggaggagattaagcgcgctaaagaagctggaatcgaggtagtggtgactgaccaccatgcgctgccccagcagctaccacccgcggatgctttggtcaattccgcatttgaggaaaacagctcgccctgtcggtacctgtgcggtgccgccatggcatttaagctgattgctgcattggaacagcagatgcagggggaggatccccagaacctgctactagaacagtatggcgacctggtggcaatcgctacactggctgatgtggtaccgctgaaaggggaaaaccgcatcctgacccggctggggcttgaggtgctggcccaaacagagcgacctggtctattggctttagctcaaaatgccaaagcagatctggcagcctgcaatagcgataccatctcctttatactcgcaccgcgtatcaatgtgactgggcggataggaagtgtagatactgcggtacagctgctgctgacccaaaatgaggaacaggcagtggcacttgcggcggagatagaaaagctgaatgcggagcgtcgccgtatggaggaaaatatctctgcggaggcatgggagttgctgcaccgcaagcctgatctgctgcacaacagaatattgacgctggtgggggatgactggcatttgggggtgattgggattgccgcggctcggatgctggaacgctaccgcaaaccatgtattatcatttcttgctctaatggtattgccaggggttcggcccgcagtgtggagggctttagtatcattgatgccattgctgcgtgcagcgagaggttgcagaaatttggcggacaccccatggctgctggctttacactggcggaggaggatattccggcttttactgccgcattggaagaatatgctgcggagcattatcccattatgccagtgcatacggtaaagctggatgcccccattgcgccggaggagattaccgtggcgaatgtagaggagatgagccggctttctccttttggatgcgaaaaccccatgccgacttttttactacctggtgtgacagtgcaggctgtgaattctattgggaatggtaatcatctgcgtatgtctgtaacagctgggcggtatacagtaccgatggtgtacttcggaatgcctgtaaagcagtttcccttttcgattggcgaccacatagatgtggcctgtgcgttaagtatcaatgattttaatgaccagcggacggtttccgtacgggtcatcaatgtgcatccgacgggctggcggcagggagagaatctgcgtgcagcagcggcctttgaggcggtggtgcgcggagaagaaactgctgatgccacggaagtctttacccggaacgacttggcaggagtgtatcgttatctgcgggataacagccccataaagacaggaacggacggaatgtactacatattgcgaaaaaagttggatggctatacctactttaagcatttggcggcactgcagattatgcgggagctggagctgatggaggatatgcagcctgaaggctttgtgataaaaaacggagaaaagaaggtggagctggaacactcccaaaccttccgaaggctccagaaagggtag

SEQ ID NO: 2200 - DNA, 1305 bp, Unknown
  Description of Unknown: Ruminococcaceae sequence
ggaaccgccatgaaaaagctcatctgtactctgaccctgggggccggcctgctgctgggcctttccggctgcgatctttaccagcccgatgtcgattccctcctcacgcctcccgtcctttccgagctgcaaaccgaggtggatgaagccctgcgggatgtggtcggccaggagctgcgactgtgctaccccgccggcggcagctaccgctccccctacattttcaccgatctggacggcgatgaagagcaagaagccgttgtcttttacactgtggaggatgagccactggtctacctgcaaattctggataaatccgacggccgctggcgggcccgcaatgccctgcccggcactgagggcgaggttcttttcgtggatttcaggcacctttccggcgatggcgccaccgaccttttggtgggctggcgggaaccagaccgggaatttgataccctgtacctgtaccgctaccgggatgccgccctctcggaggaatttcacatcagctgcgatggcatggccattgccgattttgacggcgacggctatgaagaactcatagcggccaccgtggatggcggtgtcaccctgcagtacatcggctggagcggcgccggcatctcggtgctggattccgcttacagctccctgcgcctgcagaacatcctggaatcggtcaccggcctcatcgcgcaggagctgcccggcaccgttttctccggccgcgtcaatgccgatatgaccgcttcccttcttgtgggcgtgcagaacggccggctggtcctcccgcaggaggaagcccccgccggctatgccgatggttactgctactccggggcctccccggccgatatcaacggcgacggcatagtggagctgccctggagcgccgttgtgcccggctccgccggcagcagccgggaagagacccgctattttaccgagtaccggaccctacagtacggcagctattccaccgtggccgcctgctaccagaataccaccgatggctggcgctttatcctgccgcccgccctgtacgaccagtactggatggatgccctgaccctttcccgccgggccgagaccagggaggtcattttccggcggtacaccggcagcctgaatgaaaccggcgaggaatacctgcggctgcgggtggtttccgccgccgagggcaccgagccggagggctacaccctgctggccacccgcggtcaatttgcctactacgctttcctgccggccggcagccccatcagcatgacacaggtggaagaaggcttctccctgctgggataa

SEQ ID NO: 2201 - DNA, 1845 bp, Streptococcus thermophilus
atgttacaacgtctgaaaaactttttaataggtgaacccttgacccatgataatagcagtgatgatcacttattatctaaggttcaggcattagctatgttgtcgagtgatgctctatcatctatcgcatacggccctgagcaagtcgcattggtcttaatggctgtatcaagcgctgctatttggtggtctatcccaattgggattttggttttagtccttttgattagccttaccatttcttacagacaggtaattaaggcctatccacaaggtggtggagcctacatggtaacttcggaaaatctgtcacctaaatttggtttgatagctggaggtagcctcctagtcgactatatgttgacagtttccgtttcagttgccgcaggtgcagatgccattacctcagccattccattacttcacccctataatcttcaaatctcaataattttggtgcttgttttaatggtgttgaacctcaggggaatgcgtgagtcggcaaagtctttgatggttcctgtttatctctttattgcctcaacgttgttcctattaggatatggtttcttacagatcttaacggggcatatgccttatgcggctacggcgcatttaggccaaccgattacaggtgtgtcagtgattcttattttaagggcctttacttcaggttcggcttcattgacaggggtggaagctatctctaatgcagtgcctttctttaagaaacctaagtctaagaatgcggcatcaaccctctttatcatgtcaagtattttgggaattatgtttgctggaattacctttcttaactggtggactggtattacacctcattcaggtgtgacaatgttggcgcaactggctagggaaattcttggtgattcatggtttggcagtatcttattttatatttttcagttctcaactgccatgattcttgcagtggcagcaaatactggtttttcagcctttccgatgttgtcctttaacatggctaagaataaatacatgcctcatatctatcttgaaaaaggtgcacgtatggcctactctaacggtatcttgacgctggctattggggccattactctcttattcattttccgaggaaatacggaacgtttgattccgctttatacaataggggtgtttgttccttttgcactttctcaaacaggtatggttgttcattggagtcgtgaatatggcaaggatttctggaagcattctttagctaatattttaggtgccttaatttgttacggtattgttctcattctcattctcttccgtttaggggatatttggccattcttcccaattattgctattttgatgtggatgtttcttaagattaagaaacattacgatggggttgctcaacagttgcgtattgatggcccaatcaaagaacatcattttcaaggtaacattgtccttatcttggtgggaaatgttacaaaggctaatattggtgccatttcttatgcacgttctattggtgataaggttattgctatgcacgtgtctactaaagatacagagaataaggataaggaaatcgaacaagagtttaaaaaatatttcccagaaatcgagatggttcatatccgatcaccttacagctcaattacacagtcaactattcaatatgtagacgaagtggctactcaggctgataaggataatgcgactctgactgttttgattccacagtttgttccgaaaaaatcatggcaaaatatacttcacaaccagacgagtttacgattgaaatattatctcaaatggcgtgaaaatattgtcatttcatcatattcttaccacttaaaagattaa

SEQ ID NO: 2202 - DNA, 1068 bp, Streptococcus thermophilus
atgtctaaaaaaacacaaaattgggcagttcctttaattgctgtcctcttgggaatgctggtcggtgctgttttgatgttaatctttggttatgatccattctgggcttactacgatcttttctcaacggcctttggttctttgaaacatattggtgaaattctacgtgcgatgagtccattgattctgattgcacttggtttctctgtagcatctaaggcaggacttttcaacattggtttgccagggcaggccttagctggttggacctctgcggtgtggtttgcgctagcctttcctgaattacctaaagtagtttctattgtttgtactgtcattattggtctagttgccggtggtatcactggtgctgttccaggtattcttcgtgcctaccttggaacaagcgaggttattgttaccatcatgatgaactatatcattttgtatgttgctaacaatattgtccgctttggtttcacagctgatatgttacgttcatcagaagcctctaacagggtttcagcttccgcaagttaccaaacagattttctgtcttctttaacagatggatcacgtttcaatattggtttctttcttgctattgtagctgtattcctagtttggttcatgctcaagaaaacaacaacagggtttgaaattacatctgttggttttaatccaaatgcgtctgagtacgccggaatctcatcaaaacgagtgattatcatgtctatgattatttcaggtgcactctgtggtcttggaggaacagtagaaggacttgggactttccaaaatgcctttgtacaaaattcttcattagctatcggttggaatggtatggccatttccctcttagcagccaattcaccaattggtattccatttgcagctcttctctatggtgtcttgtctgttggtaaaactggtatgattggtgtgccatcagaaattattgatgttgtatcagctttgattatctttttcgttggtgccaactacattattaaatattggattcgccctcgtcataaatcagtgaaagctaaaggaggacaaaactaa

SEQ ID NO: 2203 - DNA, 1212 bp, Streptococcus thermophilus
atgtccaaatttaatcgaatgcatttaatcgttcttgattcagtaggtattggtgcagctccagatgctaataattttgtcaatgctggtgttcctgacggagcttcagatacccttggacacatttctaaaactgttggtttgaatgtgccaaacatggctaaacttggtcttggaaatattcctcgcgaacaacccttgaaaactgttccagctgaaagcaatccaactggttacgcaactaagttagaagaagtctctcttggaaaagataccatgacaggtcactgggaaatcatgggacttaatattacagaaccttttgatactttctggaatggattcccagaggaaattcttactcaaattgaagaattctcagggcgtaaggttattcgtgaagccaataaaccttattctggtacagcagttatcgatgacttcggaccacgccaaatggaaactggtgagttaattatttatacatcagctgacccagttcttcaaatcgcagctcacgaagatattattcctgttgaagaattgtatcgtatttgcgaatttgctcgttctatcactttggaacgtccagctcttcttggtcgtatcattgctcgtccttacgttggtgaacctgggaactttactcgtacatctaaccgtcgtgacttggctatttcaccatttgctccaactgttttggacaaattgaacgaagcaggaattgacacttactcagttggtaagattagtgatatcttcaatggtgaaggtatcaaccacgatatgggtcataacaaatcaaataaccacggtgtggacaatttgattaaggctatgacatcagaagactttaaacatggtttctctttcacaaacttggtagactttgatgccctttacggacatcgtcgtaatccacagggctaccgcgattgcttgcatgaatttgacgagcgcttgcctgaaattatcgctgctatgaaagaagatgatctcttgatgatcactgcagaccatggtaatgacccaacttatgctggtacagaccatactcgtgaatacatcccattcttggcttacagcccttccttcaaatgtagtggcttgattccagttggacatttcgctgatatctcagcaacaattgcggataacttcggtgttgagaaagccatgattggtgaaagtttcttggataaacttgtctaa

SEQ ID NO: 2204 - DNA, 1275 bp, Streptococcus thermophilus
ttgtggcggtggtcgatagcttcttccgagatgaggagtgattcctcatctcagtttttagtctggaggataattatgataaagacaatagaaacagatataggaacatattattttgattctgttaattttactttatctttgtcacctatttcaaaacaaagttcaccaactctagattctgttgaagatggtgtattaaaaaaagtagttataaatatttctaatagttgtaatttatcttgttcgtattgttatgcagatggtggtaactatggtatggataatcgtattatggatttaactactgctgataatattatccaagagatagcaagtaaaggagttacacaaatcaaccgtctcatacttttcgggggagaaccttttttaaatatagaattatttatatattttatagaaaaattatctacattattaaatgtagtgaaaattgaaacagttactaatggtactgttttaaataagcgtgttaaagaaatgcttgttaaatttcatccttatttaaccataagtttagatggaccagaaattgttcatgatagactcagaggaagagggagccatcgaaaaacattacgttttattaattatttaaagaatattgattatgaaaattttgaaatagcctcgacatatactagacttcatcaaaaaaatggtctaagtagagaagatatctttcaatattttactgatatggatgtgcattttaatataaatgatgtttttactaaaaataaagtgctaattgtgaaagaaatggaaaaaagtttggctgaaagaaaacagttcatagataaatccattcaacatgtaatcaacaacaatgagaaggcatttatcagtcctattttatatgatgtattaatatcaatgatatacaagagtacgaatcgtacattttgtgatgatattgacccttcgaatacattaacttatgatgtagatggtagtaagaaactatgtttcagattttggggaactcacaacagtcctaaagcggaatcatttaacaacaaagataactttgaaaagtgtaaaaactgctggtgtagaggtatgtgcttggaatgcgttgccaatgttattgatggatattcttctgtaattagtgaagatggggaatttcttgaatgctctaaaccagaactgatggaatactgtattaaacagattatatatttatccaaggacagagaaaaattatctaggttggtaaataattttagggggtttatacgctatgcttag

SEQ ID NO: 2205 - DNA, 948 bp, Streptococcus thermophilus
aaaaggaagaatatgacaaaaataatatttatgggaacgccggccttttcagcgacagtgctggagggacttttgacagatgagcattacgacattgtcgctgttgtcacacagccagatcgtgctgtcggccgaaaaaaagaaattcgcatgacaccagttaaggaattagccttggcgcatgagttgccaatctatcagcctgaaaaattatcaggctctgaagaaatggcccaactgatatcacttggagctgatggtattgttactgcggcttatggtcaatttttgccaagcaaattgcttgatagcatggactttgcggttaatgttcacgcatcgctcttgccaaaatatcgtggtggtgcacctatccattatgctatcatcaatggtgatgcagaagctggtgtgaccattatggaaatggtcaaggaaatggacgctggtgacatggtcagccaaaaggccttgccaattctggaccaagataatgtcggtactatgtttgaaaaattggcagttttgggtcgtgacctcttgcttgaaaccttgcctgcctacattgcaggagaaatcaaacctgttcctcaagatgccagtcaggtaacgttttcaccaaacattagcccagaagaggagcgccttgattggaataagtcgggtcgtgacattttcaatcaaatccgaggtatgtatccatggcctgtggcacacactttgcttaatggcaaacgtttcaaaatttatgagggagacttagtagaaggacaaggacaggctggtcatattatcgaaaaaactaagaagagtttggtcgttgcgactggtcagggggctatttcgcttaagagtgttcagcttgaaggtaaacctcgtatggctattgctgatttccttaatggagtcggtcgcaatcttgaagtaggtgatgtctttggccaatga

SEQ ID NO: 2206 - DNA, 699 bp, Streptococcus thermophilus
ttgagtgtgtctgactttcgttcgggtatgaaagccgcagtaccgacagctctaggatatgtggctattggtctagcatttggtgtcgtagcggcagcttctggtctatcggctcttgaggttgctctcatgtgtgcattggtctatggtggctcggctcagtttgctatgtgtgctttagtcgttgcaggagctggccttggtgagttaaccttgactgttttcttagttaatttgcgtaacatgttgatgagtttacatgcaacaacgatttttaccaaaacaagtctctggaatcagctgggaattggtagtttgattacggatgaaagttatggtgtcttattaggagaatatgtacatcataaagatattccctctaactggatgcatggtaataatattttcagttatttggtttggattgtgtcgtcagttgttggttgtttaattggctcaatgattccaaatcctgagctttttggtttggattttgccttgattgccatgtttattggtttgttaagtagtcagtttgatgccttgctatgtgaaggagtgcgtaagctgtttctgattctgttatctattgctgtggcatatctgagctttagcatcattttgtcagaatctttggctgttctagtggctactttgattggatgtagtgtgggggtgatgtgtgatggccgtcaatag

SEQ ID NO: 2207 - DNA, 1248 bp, Streptococcus thermophilus
atgatagacttcttgaaacagcttccccatttagaaccctacggtaatcctttctatttcatctatcttggaatagccttattaccaatctttataggtctattctttaaaaagcgctttgctatttatgaatgcttggtaagtattacctttatcgttcttgctctgacaggtacccatgctagccaaatcttagctttgcttttctatattgtctggcaaatcatctgggtatactcatacaaacgttatcgtagtcaaagggataataaatgggtcttctatttgcactcgtttcttgttgttcttcccttgattcttgttaaggtagagcctaccattaacggaacccagtcacttttaaactttctcggcatctcttatttaaccttccgtgcggttggtatgattatcgagatgcgtgatggagttcttaaagagttcacactaggggaattcctccgcttcatgctctttatgccgaccttcacaagtggtcccattgatcgcttcaaacgttttaatgaagattatcagtcaattcctaatcgtgacgagctgctgaacatgttagagcaagctgtaaaatatattatgcttggttttctttataagtttgttttagctcagattttcgggagtatgcttttaccaccattaaaagcacaagcattgagccaaggcggtatctttaatctacccacattaggtgttatgtacgtttatgggtttgatctcttctttgactttgcgggttactcaatgtttgctctcgcagtttcaaatctaatggggattaagagtcctattaactttgacaaaccgttcatttcccgtgatatgaaggaattttggaatcgctggcatatgagtctgtcgttttggttccgtgattttgtctttatgcgcttagtcatagtactcatgcgaaataaggttttcaaaaatcgtaacaccacatcgaatgttgcttatatcatcaatatgatggttatgggattttggcatgggattacttggtactatattgcttatggtatattccatggtattggtctagttattaacgatgcttggttacgtaaaaagaaaaccattaataaagatcgtaaaaaagcaggacttaagcctcttcccgaaaataaatggaccaaggctttgggaatctttatcacatttaatacagttatgctatcattcttgattttctctggattcttgaatgatctctggttcactaaaaaataa

SEQ ID NO: 2208 - DNA, 1317 bp, Streptococcus thermophilus
atggttatgaggtcatcggagactaatatggaaaacaatcgtattcaaatacttaaagaaattctccttgatttacatcatggagctagtcccgaaagtgttcaagagcttttcaatcaacacttcaagggagtatctgcacttgaaatatctatgatggagcatgaattgatggcatctgaagatggggttacctttgaagatgtaatgagtctctgtaatgtccatgccaacttattcaagggagcaattgcagatgtcgaagtagcagatgctgatcaagaaggtcatcctgtctatgttttcaagcaagaaaatctagccctacgttcagctatacttcgtatccgtcgtatcatagaaaacatcagtaaacctgaaaatgagccctttaaatctgatttattaaacggtcttaagcatcagatgactttacttgggcaattccataatcattatacgcgtaaagaaaagcttttctttcccattatggagcgttatggtcacgattcacctccaaaggttatgtggggagtagatgacgatatccgaaaactctttcgagatgcagagtctaaactccaagaactttcgaactctgatgctgatattgaagaattctcaaaagcattcgaaacatttttggaagaatttgaagctatgatcttcaaagaagaggctatcttacttatgattctgcttgaaaccttcacacaggatgattggctttcaattgccgaggaaagcgatgcctacggctatgcaattataaaaaaacagtctaggacaaggactgaggaaaataccgaaaatactcgaatcatcgacactcctgagggtcaattcactatcaccttcatgccaaaaccaaaaaatgaatctatcgcaaacagagaaaccactcagccatttggtaatggttacctttctgttgaactggctaatatcattcttaatcatcttcctttggaaatcacttttgttaataaagatgatgttttccaatactacaatgataatgtcccggcagatgagatggtcttaaaacgaacacctagccaaattggacgaaatgttgaactttgtcatccacccaaagtacttgataaggtcaagaaaatctttaacttactcagaagtggggaacgtgaccaagttccaatgtggttcaagtctgaacgtttaggaaaattcgtctatgtaacttatgctgctgtcagggatgaccagggggattttcaaggtgtcttagagtatgtgcaagatattcagcctttctttgaattggaaagtgatctaaatagagatatcgattaa

SEQ ID NO: 2209 - DNA, 1050 bp, Streptococcus thermophilus
atggtagtctattctggacgaacagttgaacaagctatcgagaaaggtttgagagaccttaatctaccgcgtatgaaggctcatattaaggtgatttctcgtgagaagaaaggttttttagggttcggaaagaaacctgcccaagttagcgttgaaccaatcattaaagaaatagctcacaaagctgatcgcgatgttattaaagtggctcctgatgctgtaaatcagccggatgattttgttacaagttccaaagaagaaactactgctttcaagaaagtgacaaagcttattacggtttcagataataagggagaggcacaggaaatcttaaagcaaccagtggctactgagacctttggggaagaagtgcctggtaaaatacaggggcagccaaaggcgacaatcattcctttatctgttaagcacgagtcatcagaagaggatgctacagaacctaaggttacttctcttgcgcccaaactagaacctgttgctcaacttcagaatgtagaaacttcagaatcagaagatgatttcagctcttttgtggcatctgagtttagttcagttgaatcttctgaaagcaattttgaagaagttcaatcagcggcagatgacgttttatcttaccttgaaaaaatcatctatgaaatggatgttgatgctagtctggaggttagtcacaatcgtcgtaatatcattatacagattgagacagaccagccaggacgtgttattggctatcacggtagggttcttaagtctttacaacttttagcacaaaattatgtgcacgaccgtcattctaaacgctctagtgttgttcttaatgttcgtgattatttggagcaacgtacagagactctgattgatttagcagaaaaaatagcagccaaagtaaaagaaacagggagagagtatgtgatggatccaatgaccaacagcgaacgtaaaatcattcataagtatctctctcaaattgaaggtgtagaaagtcactcagaaggtgatgatcctaatcgttatgttgtggtgacaaaagtataa

SEQ ID NO: 2210 - DNA, 1263 bp, Streptococcus thermophilus
atgatttatcaagaagcattggattggattcatggtcaattaaaatttggcattaaacctggcttggaacgtatggcctggatgcttgaagaactaggaaacccacaggacaatcttaaggctgtgcatattgtgggaacaaatggtaagggatctactgtcaatgccttacaaacgattttttctcaagccggctatgaagttggaacatttacctcaccctatattattgatttcaaagaacgcatttctatcaatggtcagatgatttcagaagagaatctacttggcttggttgagcgtgttaagccggtggttgaacgtctcccaaaagagacagagcacgaaaatgcgacagagtttgagattatcacagtcttgatgttcctctactttgggcaagtccatcctgttgatattgcttttattgaagctggaatgggtggcctgcatgattctaccaatctatttagtcctctagcggtcatctgtccatcgattggcttagatcatcaggcggtcttgggcaatactcatgctgaaattgctacagaaaaggctggtgttttaaaaaatggagcatcttttatttatgcgactgaccgtactgacgttcgagatgtttttaaacagaaggcgaatgaagaaggttctaagacctatgagttgggtaaagatttcaccgctgaagggtctagccattcctttgattttatttacaaggagcagaggttggagggtatagccttggctatggctggtcaacatcaggtggcaaatgctagtttggctatcatggctagtcttttgcttcaaaaggattatcctaaagtaactcctgaactcataaaggatgcactggctcatgctagttggttaggtcggacagagttcttgatgcctaatcttatgatagatggtgctcataataacgaaagtgttaaggtcttaattgatttgttaaggtcagagtatgcggataaggatatcgaattgcttttcgcagctattgatactaagcctattgatagtatgttggctcagttagagtcagtcggtgatttgacagtaacaagctttgagtatccaaatagtgtaaaattggacaagtacccagttacttataaacaagtgtcagacttccagacatggattgaggaacacgtgactgctaatgatgataaactttatgtaattacaggatctctttattttatttctcaagttcgaaaatggattttagagcaggaaagtgctgtttaa

SEQ ID NO: 2211 - DNA, 1368 bp, Streptococcus thermophilus
atgaatccacagttgtttaaaagcacagagttttaccatcgtcgctaccacaatatgtctactgttttgattactcccttgattttgttagttattttcctttttcttttcgctttttttgctaagaaggaagttacagtcacgtctagaggaagtatagagccaaccaaggttatcgcagtaatccaatcaaccagtgacaataccatcatagataatcaactggttgctaataaggttgttaaaaaaggggacaccttagttcagtattcagagaccatggaggcatcgcaaaaagaggggcttcaaaagcaactagaacttttaaaaagacaggaatcaggtttgaagaccttgcaatctagcctaacgcagggaaccaatcttttccaagaacaggaagacgagtttggttatcagagtacttttaacacctacctaagtcaggcacaggatattgacttgggtgtggctaaaacaaatacagaggttaataaccaagcagcaattgcgagtaataccggttctgctattgataaccagattagtcaattgcagactcaggtctcagagtatgaggcgctctctcaagctattaccaatcatgaaacgactttacctgaaggcaatcctcatcaggcaaccttaaatgcctataacagtcagtatgctacgacaccggatgccagtgtaacagaccaatacctatctcaagttaataccaatatttcgagcttgaatgcttccataggtaatctagaaatccaaaaggctgggacaggcacagttgtaacttatgacaatagtgatagcactaaaaaagaagctctaaaaaatcaattcttgcaaaatgcaggacagcaattgagctcagtggaaacacaaattaacgataccgagagtaaaatcaatcaggcagatgtccttctgactaataccctcatccagtcaccagaagatggaatcttacacttgagtcaagctgataaaaaagcaaccatggctgcgacaggaactgagttggcccagctttatcccgatatgactcaaacccaggaagttgccattacttattatgtgaattcggattatgtgccaaaactgcaaaaaggccagtcagttcgactgaccttggataaggttggtaatcacggtaccacaattattggaaaacttgagagtattgataattctgccacggaaacagaaagggggaatgtgtttagagtaactgctagggcaagtatttcagaaaaagaagcccaaaatctacgttacggtctagaaggtcgtgtgacaagcgttattgaccaaaagacctacttcaattactttaaagacaagttactaaacttgcaagaccaatag

SEQ ID NO: 2212 - DNA, 1344 bp, Streptococcus thermophilus
atgatgttaacaacgttatggctactttttctcacccttttaagtgcaggcctagaaattattcttttcctttatttaatgggacagaagattcgtctgaggtattttttcctactccttatttttaatttagcctttaattttatttataaccactcttcttggtttatcattaaattctggggtgaggatatctactatcttctgctctccttccttttatccactaagactaaaaaaccattaaaaataaagattttcaatggtctcttccctgatatcctcaacaaccttagtttaagactgattactttttttatctttcctttttttaatattagtatcaccgattataaaagctctctattaatatccatcccttcatctatcgcacctctttgtctatcatttctctttattaaattattcaaggagagttttaccatacttcaaaagcagaaatcaaattctccgattcaacatattattatagttgctaacttttttatgtttgggtacaccctactgttacagtccctcatgtatcttgaaaacactactcactcttcaactttggagcttcgaaaactctgtattgttatttcacttgtcctcttcttcattatgattgtctttttagaaagaaacattcgtgaaatgattcaaggacaattggacttccagaaaaatctccagctagagaatctctacacctacaataaacatattgaatgtctctacaattctgttcgtagttttagacacgattatagtaatctcttagtcacattacgattggggatagataaagacgatatggatattgtcaaagaagtctatgatagtgtgcttcaagaatccgataaacgattaaatacaagaaactttgacttagctagactcgttaatattcaggataatactttgaaaagccttctgtccgcaaaagttttacaagcagaagaagaaggtattgaagctcagattagcatcccagaacccatccacttgattgggatggagactctggacttcattatcgtcacttctatttttttagataacgctattgaaggtgccattcaaactcaaaaccctaaaattactattagcttttgggaagatcattgttcacagctattatctattagcaataccataagtgaagaaaaaacagaaaccaaaaccatatttgaaagaggtgtctccaacaagggacgagagcgaggcattggccttgctaatgtcacagaaatcttagataactatatcaatgtaaacttagaaacacagagtaacaatttctcattcacacaacaattaacaataactaaaaaggcctaa

SEQ ID NO: 2213 - DNA, 1044 bp, Streptococcus thermophilus
atgcatctagagaaatctagatgctttttttcattttatgacattttttgcgaatacataatagagtgtataaaggagggagtcatgttaatcgctaaaaatcagaaagggctcttagtttcggctcttgaaaatgggttgaatcgtgaggaaacttataggtgccctggctgtcaaggaattgtattgttgagacagggaaaggtgatatgcccgcattttgcccataaatctttgcaggattgtcagtttttctcagaaaatgaatcggcccaacatttatccctaaaagccactgtgtatcaatccctggacaatcatggtgaaagagtttgtattgaaaaggttctgcctgagttaggtcagattgcggatttattcgttggagattccttagccttggaagtccagtgttctcgtttatcacagaaacgtttaagagagcggactttagcttaccatcaaataggttacgaggtacgatggcttttggggcaagaactgtggttgggacagcgtttaacagatctacagcgtgattttctttattttacaactaagataggtttccacctttgggaacttgattggaagagggaagagattagacttaagtatctcatctatgaggatatttttgggagagtttattacttaactaagacctggtctttaatagaaaatctcatgaccatattacgttttccttatcaggccagaaaggtggagacttatcaagtgactcagcgaaagaaagtctcacatgttattcaacgggaattaatggggaaaaatccaagatggatgagaagacaggaggaggcttatcttaaggggatgaatttgttaagtttgtccgatcaggatttttttccacaagtgcggtttcctgagtctaagcatggatttgtccaaattagattatctattgatggttttgaaaagcttttcatgcagtattatcgaaaaagggatttttcttacaagcaaaccctgtgccctcccaacttttatgctaaaatagtagattatagacacaattaa

SEQ ID NO: 2214 - DNA, 2316 bp, Streptococcus thermophilus
atggtaaaatggaagttatatcaaatgaatgatataaagttgaccagttcgtttttgtggggttggttatggataaaaagagggatcaacatggctaaacaaacttttgagatgacctttgaaggacgcccacttgttgtggaagtgggacaggtagccaagcaggctaatggtgccgttgtagtacgttatggagatacaaccgtattgtcagtagctgttatgtctaaaaagatggcaactgcaaatttctttcctttacaggttaattatgaggaaaaaatgtatgcggctggtaagttcccaggaggctttagcaagcgtgagggacgaccttcgactgatgccactttgactgctcgtcttattgaccgtcctattcgtcccatgtttgcggagggttttcgtaacgaagttcaagtcattaatactgttctctcttatgatgagaatgctagtgtgccaatggccgctatgtttgggagttctttagcactttctatttcggatattcctttcaatggtcctattgctggggttcaagtggcttatgcagcggaagatttcatcatcaacccaagtgcatcagataaagaagtttcacatttagacttgatagtggcaggtaccaaggaagccatcaatatggtagaagcaggtgctcaggaattgtcagaggacatcatgttgcaagcacttttgaagggacatgaagctattcaagagttggttgatttccaaaattatattgttgcggctgttggtaaggaaaaggctgaggttgaactgttccaagtggatgctgatttgaaggctgaaattgaagcagtttattatgatcagttagctaaggctgttcaggtggaagaaaaactggcgcgtgaggcagcaaccaaggctgttaaagaagaggtcctcgcttcttatcaagaacgttttgcagaagatgaagataaggaaaccattctacgtgatgtggtagaaatccttgagcagatggaacatgctgaagtgcgccgtctgattacagaagacaagattcgtcctgatggtcgtcgtgtggatgaaattcgtcctttggatgctgaaattgactttctgccaaatgttcatggatcaggtctctttacacgtgggcaaacccaggccttatcagtcttgactttagcccctatgagtgatacacaactcgttgatggtttggatccagagtataagaaacgtttccttcaccactacaatttccctcagtattcggtgggtgaaacagggcgttacggtgcaccaggccgtcgtgaaattggtcacggagctttaggtgaacgtgcccttgctcaagttcttccaagcgttgaagagtttccatatgctatccgtttggtagctgaagtcttggagtcaaatggttcttcttcacaggcttctatttgtgcaggcactttggctcttatggccggtggggtgccgattaaggcacctgttgcgggaattgccatgggtcttatttcagatggaaccaactacactgttctaaccgacattcaaggtttagaagatcattttggtgatatggactttaaggtggctggtacacgtctaggtattacagctcttcagatggatattaagatttcaggaattacacctgctattcttgaggaagctttagctcaagctaaggtggcacgttttgaaattcttgatgttattgagtcagcgattgctgaaccacgttcggaattggccccaacagctcctaagatcgatagtattcagattcctgttgacaagattaaggttgtcatcggtaagggtggtgaaaccattgacaagattatcgatgagacaggtgtcacaattgatatcgatgaagaaggactcgttcagattttctctagtgatcaggatgctattgaccgtgctaaaacaatcatctctgaccttgtacgtgaagctaaggttggcgaggtctacaccgtaccagttgtgcgtattgaaaagttcggtgcctttgtccacctcttcaataagactgatgccttagtccacatttcagaattagcttggaaacacactgagcatgttgaagatgtggttaaggttggggatatggtaaccgttaaaattatcaaaattgatgaaaaaggtcgtgttgatgcttcaatcaaaaccttgcttcctaaacctgaaaaaaatgaagacggggaaaatggagaagagcatcgtcactgctgttgttctcatcataaaccagaccatcatagtgaaagtatggaagcaccgaaaaaaagtgatgaatcagaaacgaaagaataa

SEQ ID NO: 2215 - DNA, 1095 bp, Streptococcus thermophilus
atgagtaagagagctgtgttgatgatgacctttgggtcaccagaagagattacctatgaaggagtagcggagtttttcacgaatatacggcgtggtgttcgtcctgaaccacataaaattcagactttacatgacaattacctccgaattggtggaactccactccaaaggataaccagagaagaggtggatttggttgcttctgctcttggagaacaagtgtcggtttactttgccaataaattttcacgacctttcattacagatgtgattacacagatggagaatgacggaattgaagaatgtttgtgcttgattttagagccccattattcttactattctgtcatgggatatgagaaatttttagaaagtgagcatattaggttccaaattatcaaggactggtaccgcgaaccttctcttcttcactattgggctgatgaaatccggaagattttagatcagattggagacgacagttataaggtgattttttcagctcacagtgtcccagttttggcactagattttggtgacccttatatcgaccagatttatgataatagtcgcttaattgcggaggatttaggacttagagaagagcagtacactaatacttggcagagtgagagtgatataggtattccttggattaagcctgatgtcttagaatatctacgagatgagcgtgaacacccagaccactatatttttgtccctattgtctttattagtgagcatattgaggttctttttgataatgatgtggaatgtaaggaactttgccaagagctaggtgtagcctatcacagacctcccatgccaaatcgcgatcctcgtttaatcaaggcccttctttcggctattcagtctcatatagacggtgactatagttactatcaacctcagcttgagacctttgatgagctggaaactccttctagcacaggtcagattttggatgaggaaaaggatattcaaatgcccgatttcgtcaagaaattgattgctaaaaaaggtctagaaaatgtcaagatgccatatctatttaagaaaatgcttgaaaagaagtatggaaaaaaatatgattag

SEQ ID NO: 2216 - DNA, 528 bp, Streptococcus thermophilus
aagactcggtctttttacttctatgttaaaatagaagaaagatttgaaaaaggggacgagatgatagtaaagcttggtgggctcatattgaaattgaaaatagtggttagccttatattttccgtcttgtctctatggatcctttttcctgagcttattagaggttcccttcgtgaagatctagtcaagcagttccttggtctcattgttttattttggctcttattatccattgttcttctcatagatggtattgtaaatctcaaaggtcatggaaaactgttggaacttgatgacaattctttgacctactacggccaagtatttggacgcaaaacctttgaaattcccttatcagagattgagtttgtcaagaaggcttggtcaacgcagatggaggatattgaacgctcttcgatggtgagatattctttgaaatgcatcgagcatgtctttgacttgatgctgaagttgatgataaaaagagatatcaggtcttgcttatcttcttcaaaaatggtgagatag

SEQ ID NO: 2217 - DNA, 1026 bp, Streptococcus thermophilus
atggctgtcgcagagacttccttagttcaaaaagaaccaccaaatttcaacgatcatcaaccagaaaatcactcaaaaattaatcgagaaagtctctatgaccgctatcaccgaaactttatcggttcggtctctacttcgacagtcatccgtaaattgaaagagttcgagttcaagtctgatcttaaccaccttccagaacacatgagctgggatgagtacagcttcaagaaaggtaagatgagctttattgcacatgactacgatacaagaaagatcgtatctatcctagatggacggaatcaagcaactattcgcaatcatttccttcgttattctagacaggtgagatgtcgtgtgaaagtcattaccatagacatgtttagtccctactacgatattgctagaaaacttttttcaaattcaaaaatcattctcgactgctttcacattgtccagcatctcaatcgagcaatgaatcgcgtatgcatacaaattatgaatcagtttgatcggagatcgcacgaatataaagcactgaaacgttactggaaactcatccaacaggatagccgtaaactcagtgataaacgattttatcaaccaacttttcggtcacacttgaccaataaagaggttctagaaaagctcctttcatactcacaagaacttagacagcactataatctctatcaactcctactctttcattttcaagagaaacaaacggaacatttctttaatcttattgaagaaacaatttcttctgtaaatcctatttttcaaactctttttaagaactttttgaaagataaggacaagattatgaatgcactggaacttccccactcaaacgcaaaactagaggataccactaacctcatcaaagacatcaagcgaaatgcttttagattccggaactttgacaactttaaaactagaattttcattgttttgaacatcaaaaaggagagaaccaattggtcctctccaggttgtaacttttcatcaacccactacagttga

SEQ ID NO: 2218 - DNA, 1446 bp, Streptococcus thermophilus
atgattactattgaacaagttctagaggttctcaaaaaggaccataattttagagatattatcaaccaagagcactactactattcatggactggggtgacttttgatcatctttcttacgacagtcgtgatatcacaccatctaccctattttttgccaagggagctggcttcaaacttgagtttttggagagtgctgtccaggctggattaggcttctacgtggctgaaaaagattaccaagtaggtatccctgcaattctcgtttcagatatcaagcaagctatgagtctcgttgctcaggccttctaccaacaccctcaagacaaactaaaactactagcctttactggtacaaaagggaagacaacagcgtcttactttgcctttaacatacttaagcaaagtcataagcctgccatgctctcaaccatgaacacgacactggacggaaaaaccttcttcaaatctaacttaactacacctgaaagtttggaccttttccgtatgatggctgaagctgtatctaacggcatgacccacctgattatggaagtttcaagtcaggcctatctaaccaagcgtgtctatggtttgacctttgatgtaggtgtctttcttaacatcagtccagaccacatcggacctattgaacacccaacctttgaagactacttctaccacaagcgtctcctcttgaaaaatagtcaagcagttattgtcaatagtggtatgaatcacttcgattttgttgctgaagaagtcgctgataaagaccacgacttctatggtaaggactctgaaaataccgttaaacatagctcaggttttagctttaaagccaaaggtaaactagctggtgattacgatatccaactcattggtgactttaatcaggataacgccatggctgctggtttagcctgcctacgtcttggagccagtcttgaagatattaaaaaagggattgctcaaacctctgttccaggccgtatggaaattctcactcaggcaaatggtgctaaggtattcgtcgactatgctcacaatggtgacagcctagacaagctcttgcaagtcgtaactgaccaccaaaaaggtaagattagtttgattctaggagctcctgggaataagggcgagagccgtcgtcaagattttggtcacgtcctcaacacttaccccgaaataaatgtcatcttgtctactgatgaccctaacaaggaagacccccttactatctgtcaagaaattgctagtcatatcaatcgtaaggttcgtatcattattgatcgagaggaagccatcaaaacagccatgtctgaaaccacaggatcaagcgatgcccttgttatcgccggtaagggagctgacgcctttcaaattgtgaatggtaaacgcactgattatgctggtgatattgaagtcgctaagaaatatttgtaa

SEQ ID NO: 2219 - DNA, 1719 bp, Streptococcus thermophilus
atgcataagaaaaccgttattgattttaaagaacttggcgtcagacaaatcttcactcacgccataaaagagataaaaaccaaagacattaaggaagttaaatcacttataaatcaaatagaagcctatcaagaaaaaggctattttgctgtaggctatgtagcctatgaagcttctcaggcctttgaacctaaatttcaaatttttgatagcccattaatgtcagagtatcttctctattttactattcacgacactgttcaaacagagtctatccctcttgcttatgagcctgttcccttaccagaatcttggcaagaactaacttctgcagaggaatacaaggctgctattgagcatatacaccaccatattcgtcaaggaaacacctaccaggtcaattttaccgtccaacttcaacagaacataacagctgatccatttgccatctacaaccgattggttgttgagcaaaatgcacattacaatgcctttattcaacatgatgatgtttccatcatttccataagtcctgaactcttctttaaaaaagatggtgatgtattgaccacacgtcctatgaaagggacaacaaatcgtggcttgacaactgaaactgaccttaaacaagcacaatggcttgctcatgatcagaaaaatcgctctgaaaatatgatgattgtagatcttcttagaaatgacatgaatcgtatttcaaaaatagggagtgaaaatgtaaaaagactttgccaggttgaacaatactctactgtttggcaaatgacttcaactattgagacgcaactcctaccaaacagtcgtttggatgacatcttccaagccctttttccttgtggatctattacaggagcaccaaaaatagctactatggcaattattaaaaacgtcgaaaaacaagctcgaggcgtctattgtggagccattggtatcttgctacctaatggaccaactattttcaacgtagccatccgaacacttcaaatgcagggaaacaaggctatatatggagtaggcggtggaatcacctgggacagcaaatgggaagctgaatatgaagaaacaaagcaaaaatcagctattctataccgtcaaaatcctagatttgatcttatctcaactggacggattcatcaaggtaaactactccatcttaaagaacatctcaatcgtctacaagagtccagtcgctactttgcttatcctttcaataaagaagaagttcaaaatcaagtcgaagatttgtgtcagtcccttgattttgacacagactaccgtcttaaattgtcccttgcaaaagatggtaaacttacttttgaacatgcccaattaacagaattagacgatgatttttgtcaagcaagattagttaagcaaacacatcctttgaataacccctatacctactttaaaacaagttatcgaccacacattagtctaggacctcatgagcaaatctactataatcaaaagaaagaacttttagaaacttctatcggtaacctcgttcttaaaatcaaggaccaactctacactccacctgttcacctcggtcttttaaacggtatttacagacaaagcctcattgctaataatcaggtcacagagaaagttttgactctggaagatttaaaacaggctcaagccatctatggctgtaatgctgtgagagggttgtatgaattgagggtagatttctaa

SEQ ID NO: 2220 - DNA, 2454 bp, Streptococcus thermophilus
atgaaagaatctattataaattatttgaaagagcatgggaaatccagtgtaaatgacattgcccacgctcttaatcacgctggcggtgaaaagttcccacagcttatcaaagtcatatcagctatggaaaggaagagacagttgcgctttaatcgtgacggctctgtatccttacgtcctaagaaagaacatcccaataaggttactgtagagggtgtttttcatgccaataagaatggttttggtttcttacatatcgatgacagtgaggatgacatgtttattggtcgtaatgacgttggccatgccattgatggtgacactgttgccgcagttattaagaagccagcagatcgtttgcgtgggacaatggctgaagcaagagttgttgaaattgtcgaacgctctcttaaaacggttgtcgggaaatttatcctcaatgacgagaaagaaccttatgtaggttacattaagtctaagaatcaaaaaattcagcaaccaatctatatcaagaaaggaccagttgctcttgaggggactgagattattaaggttgatattgaaaaataccctaaccgccatcacgattattttgtaggaagtgttcgagatattattggtcatcaaggagatgctggtattgatgtcttggaagttttggaatcaatggatattgtttcggagtttccagaagatgttatggctgaagcagaggctgtgccggatgcacctagtcaagaagatctaattggtcgtgttgaccttcgtcaagaagtgaccttcaccattgatggagctgatgccaaggacttggatgatgcagttcatattaaacgtttaccaaatggtaactatgagctaggtgtccacattgcagatgtgtcttattatgtcacagagggttctgccctcaaccgtgaggctgcagcacgtgggacttctgtttatgtgacagaccgcgtggttccaatgttgcctgagcgtctttcaaatggtatttgttctctaaatcccaatgttgaccgcttgactctgtcagctattatggagattactccaaaaggcaaggtgattaatcataagatttgccaatctgtaattaagacaaccttccgtatgacctatagtgatgtcaatgaaatgttggctggaaatccagaaaagattgaacagtttaagcctatcatggattctgtgtcagctatggcagaacttcataagattttagaagatatgcgcgaacgtcgtggtgcccttaactttgatacatctgaagctcgtatcttggttaatgataagggaatgccagttgatatcgtggtgcgtgaacgtgggacggctgagcgaatgattgagtcctttatgttggctgccaatgaatgtgtggcagagcatttcgctaaggctaagttgccatttatttaccgtattcacgaagagcctaaagcggagaaattgcaacgctttatggattatgcttctatctttggtattcaaatcaaaggaacagctaataagatggatcagctagacttacaagatttcatggcgcgagttcaaggcaaacctggagcagaagtcatgaatatgatgttgcttcgttcaatgcaacaagctcgttattcagaacacaatcatgggcactatggacttgcggctcagtattatactcacttcaccagtccgatccgtcgttacccagaccttttggttcaccgaatgattcgtgagtacaccaacaatatgtctcaagaaacgcgtgaacactttgaagaggttattccagagttagctacttcatcttcaacccttgagcgtcgtgctattgacgctgaacgtgtcgttgaagccatgaaaaaagcagagtacatggaagagtttgttggtcaagaattcgatggtattgtcggaagtgtggttaaattcggtatgtttgtggaattgccaaataccgttgaaggtttggttcatattacaacacttccagaattctacaattacaatgaacgcaccatgacccttcagggtgaaaaatctggtaagactttccgtgttggccaacctattcgagttaagttaattcgtgcagataaggagactggagacattgatttccaataccttccaagtgagtacgatatcactgaaaaagtagatcacaaggctcgtcaggaacgtgaagagaaggctaagtccttccgtaatagaggaccacgccgcgatcgtcaaaatggtgatttcgaaagtcgtggtaaacgtgtaaataagcgtagcggtcaagatagtagtggttacaaaggctcttatgatgaaaagcgtaagtcatctaagaaaccagacaagcgtaagaatcaaaaccgtcctcataatgataataagggacgtgagagtggtcgtcgtaagaaaaaagaaaacaaacctttctacaaggacgttgctaaaaaacgaaaatag

SEQ ID NO: 2221 - DNA, 975 bp, Streptococcus thermophilus
atgactaaatcaatttttgaatataaggatgatcaagactggtacttggctagttttggaagctataatcacttgacatgttttggtgatgatgaggcctatgaacaatatgttgacttttttcagggcttgactaacaccttggatgttagtggttttcagttacatgttgttaaacactcttctgatcttcgcttagtgtcttttattttggattgtttgaaagaggagcttggtcgagacttggtcgttacgcaacatcaaggaactttgcttgtaagtgaaggggataagcttctctatgtccacgtacctagagaaggtgtctccttggatgatttctttggttctgataataaatcagactttggtgatgttttgttgattgcgacacgcaacgaaggaaaaaccaaggagtttcggaaactctttggaaagcttggtattaaggtagaaaatcttaatgattatccagatcttcctgaggttgctgaaactggtatgacctttgaagaaaatgcacgcttgaaggcggaaactatttcgaaattaactgggaagatggttctttcagatgattcaggtttgcaggtagatgttcttggaggtttgccaggtgtgtggtctgctcgttttgcgggtccagaagctaccgatgctgaaaataatgctaagttactgcatgaacttgccatggtacttgatgatagcaaacgctctgcccagttccatacaaccttagttgttgcagcacctggacgtgatagtttggttgttgatgcagactggaaaggttatattggtcgagaacctaaaggtgacaatggttttggttatgatccccttttcttagttggtaatacgggtaggacagcagcagagctttctacagaggaaaaaaatgaacaatctcaccgtggacaagctgttaagaaacttatggaggtattcccaggatggcagaacaaacaataa

SEQ ID NO: 2222 - DNA, 1632 bp, Streptococcus thermophilus
atgactgaaactaaaactgacacgcagcagcagcaaatgctaagagggacggcatggatgacagcatccaatattatcagtcgtctcttaggggcactctatattattccttggtatgcttggatgggcaaacagggtgaccaagccaatgctctctttggtcagggatataatatttatgcccttttccttttgatttcgacagcagggattccagttgccattgccaagcaggtatcaaaatataacacacttggaaagatggaaacgagtttcttcttactcaaacgtatcttgtattatatgattgggcttggactaatttttggtgttttcatgtattttgcttctccgtggatgtcatatctttctgggggagacgaagacctggttcgagtaatgcgcagcctttcttgggcggttgtcatttttccatcgatgtctgttttacgaggctttttccagggctttaacaacatgaagccttatgccctaagtcagattgcggagcagattatccgtgtcatttggatgctgttggcgactttcttcatcatgaaaattggtacaggtgactatgtgactgcagttgtccaatcgacttttgctgcttttatcggtatgttggctagttatggggtacttttcttctatctttggaaagaaggcaagctcaagagcctttttggtaagcaggccgttcatcctgatatcaatccaactgcaattgttattgagacatttaaggaagccattcccttcattattactggatcagcggttcaacttttccagttgattgatcaatggacttttatccgtactatggagaggtttacaagctatagtaatagtcagcttcaggttctctatgcttatttgtcttcaaacccaagtaagattactatgattttgattgccgttgctatttctattgctggggtcggcatcccacttctgacagaaaatatggttaaaaaggaccttgggggagcagccaaactcattattaataatctccagttacttttgctctttattgtaccagccattgcgggttctgtgattttggccaagccattatacactgtcttttatggagcaccagacagtcaggctcttttactcttcgtagctagtttgattcaagtgattttcttagctttgtatagtgttttagcaccaatgcttcaggctatctttgagacccgtaaagctatcaattattttgcgattggggtgctgattaaggccattctacagctaccgttgattatttttttaggagccctcggtccggttatttcaacagccattgggttaggagttcctattgctttgatgtataatcgccttcacacagttactcactttagtcgtaagatagtctttagaaaagctctactcatttgtattattacaatgctcatggttattccagttgctgttttctattggttattccaatttgtcctatctccaacaagtcgtatgggtagtgtgatttacttagtgattggaggaggtcttggcgttttggtctatggagtgcttgctcttgtgacacatatggctgatcaattgcttggcgcacgagcaggtagattacgagctaaattacatattaaatag

SEQ ID NO: 2223 - DNA, 798 bp, Streptococcus thermophilus
atggtaaaaaatagctatccgagtcgccgtctggcgaaaaagcaaaccaattggtttttggttatcagtggcatcttgactgcaattcttttagttacagcaggacttttttcagtatttggtgtcagtcgtacggtccaacaaaccaatggatcgtcagtaacaaaaaatagtaagcaaattaccgattcgactcaaagcaaggatacaaaaggactacctgatgtatcgcctaaagactggaaattgcttttggtaaatcgagataataagtctaaagagcttaatcctgagcttgctaacgtatatggtgtttctgtagatgcgagaattgcgaaaaatgttgaagaatttttagcagcagctcaagaaattaatccaagctatcatttgatttcgggttatcgtagtgttgcctatcagacagaactttataacagttatgttcagcaggaaatggctgatgatccgactttgacagagtcccaggcagagaagaaggttcagacttattcacaaccaccgggtgctagtgagcatcagacaggtcttgcgattgacatgagtactgtagacagcttagatgaagcagatccagctactgtggctaaggtcaaaaaaatagcgccaaagtatggctttgttcttcgtttcccagatggtaagacatcgtcaacaggtgtggggtatgaggattggcatttccgctacgttggtaaagaatcagcagagtacatgactgaacataatcttactttggaagaatatttggtactattaaaggagaaaactaagtga

SEQ ID NO: 2224 - DNA, 834 bp, Streptococcus thermophilus
atgattttagcggatgtcctggccgattacgagaaggagcttgaagctatcggtgaagaacctgagtccatttcctttgtttatcgtggtttgaaacaatgggatttgactcattttgttcttcaattgagacaggaagtttcggaggaagacggaaatcttttagctcatattttcacgcaacttacggctcacaagcctgcccaatatattttaggttacgaggaatttcatggtctacgttttcaagttgatgagcgtgttttgattcctcgtcctgaaactgaggaattagtggacctaattttggcagaaaacccgaacacagagctcaaggttcttgatataggcactggcagtggtgctattgcggtctccctgaaaaagagtcgtcctatgtggcaagtgacggctagtgacttatcagctgatgctttggtacttgctaaggataatgctaagctaaatcgggtagatatcagctttgttctagcggatgtttttgaaaatgtctccggttgttttgatatcattgtgtcgaatcctccttatatttctgaaaatgataaggacgaagttggtttaaatgtcttgactagcgagcccaagatggccttgtttgctgatgaagatggacttgccatttatagacaaatccttgaggacgcagataagtatctaaatcctcaaggaaaactctattttgagataggctataagcaaggcgaagatttaaggaaacttttgtcactacattttccagataagcatgtgcgtgtccttaaggatcaatttggacaggatagaatggtcgtgatggatgatggaaagtaa

SEQ ID NO: 2225 - DNA, 537 bp, Streptococcus thermophilus
aaggggaatatttgcttgaacttacttaaggggtggggcttagggactctactcttgttagcgagtttccttgggacttctttacttggtggtttagagtttgtaaaagtggacttttctcaaagaatctttatatatctcttatctttgattcctttctggtttatccagggcgggactgaggaattggtgacacgtggttggctacttcagacggtgactagtaaattgaacctttcctggggaattgctatttcaagttctctcttttcaatactacacctaggaaatcaaggtgtcactgccttgtctcttatcagtattattctagtaggagtcctcatggctctttacatgctcaagacagataatatctggggagtggcatcccttcatggtgcttggaactttacgcaaggaaatctagttggcgtggcagtcagtggacagaatgcaggtgatagcctattgcgcttccctaccaagtcaggtgtaccggattggttatcaggtggagccctttggtctagaaggtaa

SEQ ID NO: 2226 - DNA, 549 bp, Unknown
  Description of Unknown: Lachnospiraceae sequence
tatgatggtaaggttcaggtcgttgataatcatcgtatttcggttactcagtacgcgtctgtgttagatgccataaagctggccaatgaggggaaaaacgcgcttgagataaaaaaagctttagaggaagcggcttatgatgcaagtatttatattgcagtggatacactggaatttttaaaaaagggcggacgaatcactccggcggcggcggccatcggcagtgtcctcaatataaaaccgattctttcgattcagggtgatcgattggatgcttacgcaaaggcccgtgggataaaacgctgtcgggctaagctgatcgaagctctgaaaaatgattttaaagaacgtctggatggagccgatatgtcgaaggttcgggtgggaactgccggttccttccggagagcggaggatgcagaagcctggcgtcaggaagtggctgaagcttttccgggatttgacgtggtgtatggtaatctgggatgtagtattgcttctcataccggaccggaggccagaggcatcggattctataaggtattgtga

SEQ ID NO: 2227 - DNA, 876 bp, Unknown
  Description of Unknown: Lachnospiraceae sequence
atgcgttttgttattgtgacaggaatgtccggagcgggaaaaagctctgtattaaaaatgttggaggatatcgggtatttttgcgtggataatcttccggtgcctcttctgcctaaatttgcagagcttgtgtccgttcagggagaaaatgctatgcatcaggccgctcttggcattgatatacgaagtggtgaaggcctggcgacggtgaataaagttcttgaaaatatagaggatttgaaaataaattacgagattctgtttttagattgcgaagacgcagttttgatcaaacgctataaggagacgcgtcggcagcatccgctggctgtgggcggccggattgaagatggcattaaaaatgagcggaaaaagatgaagtttctaaaacagagagcggattatatcattgatacgagccagatgctgatccgggatttaaaaggcgaggtagataaaattttcgttaaaaatgaaccctatcagaacttttatctgaccgtattgtcttttggtttcaaatatggcattccgacagatgcagatttagtttttgatgttcggtttctgccgaatccttactatgtagaaagtcttcgtaaaaagacgggaaatgaaccggaggtccgggattatgtgttgaattgtaaagaagccggcatgttcttggataaggttgaggatctgcttgtatttcttgtaccccaatatattaaagagggaaaaaatcaactggtgattgctgttggctgtactggcggtaaacatcgttccgtgacgatggccaatggaatttatcatcggctggcagcaaaaaattatagtgcaaaggtggaacacagggatgtgtccaaggatgcgctcagaaataaataa

SEQ ID NO: 2228 - DNA, 948 bp, Unknown
  Description of Unknown: Lachnospiraceae sequence
aagttcggcatgggccacatgaaagccgccgaagctattaaagaagaactgacactctgccgggaacatccggaacagcgatgcacctccagagaatccgatatagaaatcatcgattggattgaatatatggcgccattctgtgccaaatacatttacggcagctattctgcgctgatccggcgcagcacagttttttataaccttcactataaatcatcggaaaaccggccgatttctcaaaaaccggacctggcctgctatatccgcatgaatcagctgatccatgataagaagccggatctgattatctccgttctggcctatgcttcaaaagctgtatcctattataaagctttaagcggttcttcgattccactgatcacctgtgtcaccgatattaccgcccattccgaatggataaataatcatacgaatgtctatgccgtcggctcggaagaggtccgtcaactttttgcccggaaaggtatccctgaaggacagatttacgtcactggaattccggtccgtcaacggtttaaaaaccaggaagctgaaagaaattcccgaccaaaaatcctgttaatgggcggcgggcttgggcttcttccgaaacgactggatttttatcaacatctgagtgagaaagtcccggcggatatgactttgatcacaggaaaaaatgaaaaattataccgtaaactccatggacgatttaaaaacatccatgttcttggttatgttaaagatatcgatgcgtattttctgtgctcggatctggtcatcacaaaacccggtggaataaccacctttgaagctatttactcggaaacaccgattttagccctcaatccgaccatgcgtcaggaaaaatataatgccgcattcatttcaaagcacgaaatcggaagaagcttttttcttgaaaatgacgcaaaagatgcagaa

SEQ ID NO: 2229 - DNA, 1527 bp, Unknown
  Description of Unknown: Lachnospiraceae sequence
cgtgacggaaaaatccgatcggattcggacccgtttgttgttgaaacagatgcgcttgacgtgcctcagcataaaaatatgggaagatcctccatgtcttatcttaccgcacttgctttgagttttaataatctgcggacgaaaaaagcgcggacacttctgacagctttcgctggttccattggcattataggtattgcattaattctctccctttctaccggtgtcaatgattatattaaatccatagaagaagaaactctttccgaatatcctctgcagatttcaaataccggttttgatttcagttcgcttatggtgtcgaatatgggagtatccggagatcaggaaaaaactttggcggacaacgaaatcaatgttgttcagatggttacaaatatgttttccacgatggataccaatgacttgaagtctttgaaaaaatatcttgaaagtggagaaagcgaaattgacgcttatacgaattctatagaatacagttataatgtggcgccgcagatttatcggcaggatggggataagtttcgtaaagtaaatcccgacagttcttttgattcgctgggaatcggttcctctgccagctccagcagtctgatgtcttccatgatgagtacggacgttttttatgaactgccgtcaaatccggcgctttatgaaagtcaatacgatgtgaaagcgggacgctggccgaaaagttataatgaatgtgttgttgttctgagtccttccggcagtatcagcgattttctgctgtatacgatgggactgagagattcaatggaacttgacgatatgattcagcaatttatgaacggtgaagatgtggaaattcctcaaaatatcggtacttacacctatgatgatattatcaatgtttcatttaaactggtagatagtttcgattattacgaatatgacgaccaatataaagtctggaaggataaaacggataacaaagaatatatgaaagcgctggtcaacaagggcgaagatataaaaatcgtcggtattgttcagccttcggaaacggccaatggcctgctgttaagtaccgggatttattatccggaatctttgactacccacgtgatcgaagaagcaaaaaagagcaagatcgttcaggaccagcttgcaaaacgggatacaaatgtatttacgaatgaagccttcggagaggaaagtaatggcgattttgattcagattccctgtttactgtagatacctctgcactggaaaatgcctttggatttgatacgagcgcattaagcagtttatccggatcgatggatttatccaacgcatttaatatggacagcagtacctttgatatgtccggcatggtggatctgggctcgattcatctgacccttccggatatgccggctatcagcatgggcgacctcatgggaagcattaggattacagcttcggccgatgatgtcaaccaactggcatcggatttactctccggttatcaggcctacacaaaagaacacccggaggcc

SEQ ID NO: 2230 - DNA, 705 bp, Unknown
  Description of Unknown: Lachnospiraceae sequence
cagctaaaactgctccgtaaagaacacatacgctatgctctgggggattctgaattaaaaaacgccgtatccagtatttctcacgatttgcgcacgcctctgactgctatctgcggttatatggatttgctggccagagaagaaacttcagatactgtccgtgaatatctctccgtgatcagcggaagagtccgggctctgaaagaactggctgaagaattgtttcgctattccgtgatcatgtctgtggataactatgcggcgagagaaaatatctccctcaaacgtactctggaagaaagccttgccgcctattatggcgcttttaaaaatgccgggatcgaaccccaaattcatcttcccgaatcagacgtcatatgccgtctgaatgcttccgctctgtcccgaatcctttcgaatattctcagcaatgctgtgaaatacagtgatggcggcttctgtatttccctggacactaatggcgtcctccaatttaaaaatgaggcggccggtctggatgcgattcaggtcggccacctgtttgaccgtttttataccgtcaccagcggaagccagtccactggtctgggactttccattgccaaagccctgaccgaagagatgcacggccgtatcgacgccggttatcacgatggctgcctcatcatccgcctcgtttttcctctgattgaattttcccattaa

SEQ ID NO: 2231 - DNA, 498 bp, Unknown
  Description of Unknown: Lachnospiraceae sequence
atggaaagaggaaggaaaatgacagcaatattagcaatttcagtagcattgatcatgggattattgatgacccgtatcttacgaccattaaaattaccggacgttacggcctatttgatcgccggtgttttaattgggccttatgttcttggacgtttgaatataccgggaataggatttgtatcgaccagcgatgttgagcagtacgctttgatttcaaatgtagcattgggatttattgcttttacaattggtaatgaatttcgtctgtcccagttaaagaatatcggacgtcaggcgatgatcgttggtattgctgaaggattggttgcatctttatgcgtaaatatagcaatgtttgtacttcacatctttcttggagccaagcttccgattacaacagccattactttgggggccattgcaaccgctacagctcccgctgcgacattgatggttgtacgtcagtataaggcgaaaggaaaattaacggatatt

SEQ ID NO: 2232 - DNA, 726 bp, Unknown
  Description of Unknown: Lachnospiraceae sequence
gtgatcgacgttaagcatcttgacaaagtctttggtgacaatcatgtccttaaagacttgaatgaacatattgagcagggtgaaaaggtcgttatcgttggaccttccggctcgggcaagagtacatttttacggtgtctgaatttgatggaaaagccaacttccggacatattgtatttgagggaaaggatatcaccgaggcgaaatcaaaagaagtcaatcagattcgtcagaagatgggaatggtgtttcagcatttcaatctgtttcctcatctgacaattaaagataatattacactggctccgataaagcttaagatcatgacaaaagaagaggcggacaaaaaagcgatggagcttttgaaacgggttggccttgaagacaaagcagatgcttatccggctcagctttccggtggacagaagcagcgtatcgccattgtgcggagcctggccatgaatccggaggtcatgctctttgatgaaccgacgtcagcactggatccggagatggtgggtgaagtgcttgacctgatgaaacagctggccgatgagggaatgaccatggtggtcgttacccatgagatgggctttgccagagaggtggcttcaagagtcatgttcatggctgacggatatattcttgagcagaatacaccggaagaatttttcgggaatccgcagaacgaccgactgaaagactttttgtcaaaagtattataa

SEQ ID NO: 2233 - DNA, 858 bp, Unknown
  Description of Unknown: Lachnospiraceae sequence
atgttcggctatgtggttatcaatgaaccggaattgaaaattaaagattatcgggaatacagaggggtatattgcggcttatgtcagacattgaagcgcaagtatggcccctttggtcagttatgtctgaataatgacatgacgtttatggccctgctgcatatgtccctttacgaggatgaggaagccggacgggagcggatgtaccggtgtaaattgcatccgacacgaaaacagaaaatctatgagaacccatgtctggaatatgcggcggatatgacgttggttttgagctactatctggccagagatcactggatggatgaccggaagccggaggccctgctgcatatgcatctgctccggaaaaaggtgcggaagcttttaaaaatttatccgaggcagttccaggcggtacggaattatgtctaccggttggaggcggcagagcgtgccggagaaaaggatctggacgtgctggccgggctgacaggaaccatgctgggcgagatcatgaactggaagaacgatgtctgggctgatatgattagagagacgggattttacctgggaaaattcatttatttgatggatgcgtatgaagatctggataaagatattaagaaacatcggtttaatccgttgacggtttataaggatcagcaggatttcgagaagaagatattttccatgttggatctgatgatggcagactgcgcccggagtttcgaaaaacttccgctgcatctggatgttgaaattttgcggaatatactgtatgctggagtatggagtaagtacatgaagatcagaaatgataaaaataagacggaggaagttcgggatgaatccttatga

SEQ ID NO: 2234 - DNA, 864 bp, Unknown
  Description of Unknown: Lachnospiraceae sequence
atgtgtgatatgacgaaacctgtattcagaccgaaaatccggcgggagcaggtcgcaggaatgaatattcattatttaaattactcgctggactattttcttgatgtacagcaaagacttggattcaaatctttggaactgtggtgcggagcgccccatgtctggctggatcatatgggctattacgatgcgaaagtcattcggaaaaaaatccgggaacggggactccaggtgcgtgtgctgaccccggaaaactgcctttatccttatcaggtagccgccagagaaaaggaacatgtggagcgcagctttaaatattttaaaaacggtattgctttggcagaagaactcggatgttctctaatggagattaattcgggatggggctatcgtaatgaggacagcgaagaggccaggaagcggagcgcagatatgctttcacggctggctgaagaggccgggcgtcagggcattacccttgttatggaatcgctgcggccggaggaaagccagattgtgacgaatctggctcaggaaaagcagatattacaagaagtcaacagtccatatttgaaaccaatggttgatctgtgtgccgccagtgtggcgggagaaacgctggcggattggtttgaagcttttggcgatgacctgaaacatatgcactttattgacggaaatccttatggacatttaatctggggggacggtacacaccatcttggtgaggaaatcgccgtaatgaatcagtatggatattcggggctgctaggacaggaaattaccgacggacgatattatgacaatccggccgctgcggatttcagaaatatgaaaaattttgaaagatatatagatgaataa

SEQ ID NO: 2235 - DNA, 1170 bp, Unknown
  Description of Unknown: Lachnospiraceae sequence
atgaaaacaatcgagggcggtgtaaccgcagcaaagggatttgaagcgtctgcgacagcagcggaaattaaatataaaggccggacagatatggctcttgtttacagtcaaaaaccatgtatggcagcaggaacgtttacgaccaatgtggtcaaagcagctcctgtgaaatgggaccaggagattgtaaagaattctccttatgctcaggcagtagttatcaactcgggtattgcaaacgcctgcaccggtgcggaaggttacggttattgtaaagagacagccagcggtgctgcagcggttttaaatcttccggagacaagcgttttagtggcatctaccggcgttatcggcatgcagctgccaatcgaccggattaaagctggttctgcaaaactggcagaaattaaaaaggacacgattgaagcagggcatgaggctgccagagccatcatgacgacagatacggtgcctaaggaaattgccgtggaatttacattgggcggaaagacggttactatgggtggtatgtgtaaaggctcagggatgattcatccgaatatgtgtaccatgcttggttttatcacgaccgatgcagccatttccaaagagttgcttcaggaagccttaagtgaggatattaaagatacatacaatatggtttctgtggatggcgatacatccactaatgatacagtacttttgctggccaatggtatggcggaaaatccgaaaattacagaaaagggcgaagactttgaaacctttaaaaaggctttgaatacggtcaatacctatctctgtcgaaagattgcaggagacggcgaaggggcaacagcgctttttgaggtgaagatcatcggtgctaaaacaaaggcagacgcggtgactttgagtaaatccgtggtaacttccagtctgacaaaggcggctatttatggccatgatgccaactggggacggattttatgcgccatgggttattccggtgttcagtttgacccggaagtggtggatttgtactttgaaagtgctgccggtaagattaagatcatggaaaacggtgtatctacgggatacagtgaagaagaggcaactaaaattctctcagagccggaagtgacagccattgccgatgtgaagatgggcgacgcagcagcaacggcctgg

SEQ ID NO: 2236 - DNA, 669 bp, Unknown
  Description of Unknown: Lachnospiraceae sequence
atggacaaaaacaaccgggggaaacatttcattttagcagtatggatgatatttacgctgtttctgacagcatgcggcaatacgtcaggcaaggaaagcatgacggaacaaccgttagccggagcgaagtcaaacaattatgcggcagctgactatggttatgatgccggttctgatataagtgttgattcggcagagatggaagcggcaggaaccacagaggagcttgatggcagtaatgtattgtcagaagatgcggcagccgcagagagtggacgaaagttgattaaaaacgtgaatctggatgtggaaacaaaggcttttgatacctttatatcggaccttgaaaaagaagtggaaagctttgaaggatatattgagtattccagcgtcggaggcagcagttatctgtctgagaacagtcagcggacagcctggtatacggtgcggattccggaagcgaagctggagacctttatatcaaaggtgggggataatggaaacattaccaacatctcacaggatatccgggatattacgctggaatatgtcgatgtggccgggcggatttcaacgctggaggctgagcttgagcggctgaatgaattgctttcggaagcttcgtccatcgaggatattttggctatcgaatccaaaatttctgatgtg

SEQ ID NO: 2237 - DNA, 537 bp, Unknown
  Description of Unknown: Lachnospiraceae sequence
tttatggataatgtctttgatgcatttaccgagaaggaaatgtcaaaggcagggaatggactgcaggtatttcgacaggaaagcggcatggatgaggatgcacgccgggcatttcttgaaaattttaaggagaaacctcatgagacgattcttggcttttgtgtgcttggcgggatattttcggaggggattgatttaaaagcggaccggttgattggagcgatcatcgtcggcacggggcttccgggaatcggcagtgagcgggaacttttgaaggcctattttgatgaaaaaaggggaaatggttttgattatgcctacctttttccggggatgaataaggtgctccaggcaggaggaagggtcatccgatctgaggatgacaaaggcgtcattgcactgctggacgaacggtttaattacaacagttacaagcgtatgtttccgcgggaatggatacctttccagaaattagacatggattctgtggaggaaaatatagaaaaattctggacagaacaaataaataatctataa

SEQ ID NO: 2238 - DNA, 582 bp, Unknown
  Description of Unknown: Lachnospiraceae sequence
atgaaagattatgaagaagaagtgaaagatacaaaagatgtcgcaaatgaaaatgagcataaagatgattatgaagatatttgttatctttgccgcaggccggagagtaaggcaggaaaattgattcatttgccgatggaaggtatttgcatctgtccggattgtatgcagcggagttttacaatgatgagcaattcaaatatcaattatgatgatttgatgcggaatatgaatctgcaggacatgtttccgggaaatctgcaggatggcattccaaaaagtcagcggttaaaaaagaaaaaaccacaggagaaaaaggaggcggccattgatctgaagcagattctgccgccgcaccagatcaaagcccggctggatgattatgtgatcggtcaggattatgcgaagaaggtcatgtctgttgcggtgtataaccattataaacgggtggcgaccaatatgatggatgagattgaaattgaaaagtccaatatgctgatgatcgggccgacaggctgtggaaaaacttacctggtgcgtactctggcaaaattgcttgatgtaccgttggctatcgcggat

SEQ ID NO: 2239 - DNA, 714 bp, Unknown
  Description of Unknown: Lachnospiraceae sequence
aaaggcgtgatggtccttggcaccggtacagtgacgacttacgatggcgaccgggtggaaccggcggcagatgtccttcaaagcggtgattatatattggcggtcggcaatgaatcgatacagtccatagatgatctgacagatatactggaacaatggaatggtggagacatgcttttaaaaattttcaggaatgatgagactgtggaagtgcgggtgacaccagtgcgtaccgaagattcgaaatataaaatcggtgtatggatccggcaggatgcacagggaatcggaactttaagctatgtggattctaaaaacaactttgcagccctggggcacagcattacggatgtggatacaagtcagagaatcgacatcagcggcggtcggctctatcagtcgaacatcctgtccattgttaaaggacagaacggcgttccgggagaaatggtcggcaatatcgattataaacatggccagattctgggaaaaatcgaatccaataatgataatggcatcttcggcacgttatctgacgacgtgtggctttacgacgaaagccaggcacttccggtaggttttcgacatgaagtagaaaaaggtccggctaccgtccgctgctgcgtcgacggcgaggtcagagactatgatgtggcgatcgaaagtctggaacttggcggctccggtaaaaaccgggatatggtcatcaaaatt

SEQ ID NO: 2240 - DNA, 711 bp, Unknown
  Description of Unknown: Lachnospiraceae sequence
ggtaatacgttgacagaggtttatgaggtgctgaaggagcagatagaaacggccctgatgtataagaatgaagagaataagagcgctgaggagctttctgtgcaggctgtggagatctgcgagtacttttttgggcgtctggcccacatacagagattgctcttgaaggacgttcaggccggttttgacggcgatccggcggctaagagtaaggaagagattattttttcctatccggggttgtatgctatttttgtgtaccgtatagcacatgaactttatataaagaatgttccgtttattccgagaattatgacagagcatgcgcacagccggactggaattgatattaattccggtgccacgatcggcgaatatttctttatcgatcacggaacaggcattgttatcggagagaccacgtgtattggcgatcatgtaaaattatatcagggtgttacgcttggtgcgctttctacgcggagcggacaacaactggccggagtgaaacggcatccaacgatcaaagataaggtgacgatttattccggcgccacgattctcggcggcgagacggtgattggtgaagaatcggtaattgccggcggctcttttattaccagttcggtgcctccgagaacaaaggttattgtgaagagtcctgagttgacatttaaggggcagtctggcgaaaatgatgtatgggaatag

SEQ ID NO: 2241 - DNA, 684 bp, Unknown
  Description of Unknown: Lachnospiraceae sequence
atgatttgtttggaaaaatcctatgaaaaagttgtggacttcgttcagaaacagattctggacggagtctacagtacaggggacaaactgccgtcagagagagagatggcgctgcaattgaatgtaagccggacttctgttcgggagggcatccgtatactggaacagatgggtgcactgtcctgtcagcagggttcggggaattatatcaccggtgattttgaaaacacgttaatacgagttatgacattgatgtttgccgtggaagggacgtcatatcgtgaaatcagtgaattccgatttgcattggaatatcaggcattgtctctgtccgttcatcatgccacggaagagcagattgaagaaatggaataccacatgagcatgttggagacggctcaggaggaaaatgtccgttcaaaacatgataaacgcattcattatctggtggtggaagcttcacataacaactatcttattgttaattttttggcattaacacaggttatggaccgatatgtcaaagatatgcgggtgcgtattttgaaagatgaaaagaaccgggaaggtttaatgcagactcacagagacttgattaaagctgtaaaggataagaatgtccagcttgggcaggaggctttgaaccgacattttgtttatatttacaattatctggatagttga

SEQ ID NO: 2242 - DNA, 951 bp, Unknown
  Description of Unknown: Lachnospiraceae sequence
atgtacttagtgattaaaaagcagaatttttatttcaaatcaacaaataaagaaacaaaggttcatggtatatgctggattcctgagaatgggagggtaagagctgtcctccagatcgttcacggaatggtagagtatgtggacagatatgatgattttgcacggtttttgtgtgcgcagggtattgcagttgttggagacgatcatctgggtcatggtgattcggtggcttcgcaggacgactggggatattttggcgataatggttttgagtgtatcgtcaatgatgttcgtaaaatacaaaaacagtttaaaaaacgttttccaggagtgccttactacattctcggacacagcatgggctcttttttaacacgctattttctgatccaatatggaaaagaggtagacggggcgattattatgggaacgggttaccattccgtgcctgttgctgtttttgggagagggcttacccgggtcatggctgcagtgaagggatggaagtatcgcagcaggtttgtcaataagatggcttttggttcctataataaaggcttcactccggcccggacagattttgactggataacccgggatgaggcaatggtggatgcctatattgccgaaccgagatgtcagtttgtgttcacactcaatggttatcatgagatgtttaaaggacttgccttcattgctcagaaaacaaatcttaaaaagatgccgaagcagcttccggtgctgtttatttccggaggagacgatccggtgggaggtaaaggacagggagttcagaaggtctatgacatgttcgttctggcaggaatggaaaatatggatattattttctatgaaggcggacggcatgaaattttgaatgagattaatcgtaaagaggtttatgatgatctgtatgactggctgaataaggaaatttcgctaaaacattga

SEQ ID NO: 2243 - DNA, 981 bp, Unknown
  Description of Unknown: Lachnospiraceae sequence
gaaaaagggatgacaatccggaatgcgcttcagtctgcttttcaatttttatatgaaatggaagaaagtatgaatcagatgttcgaaagcatggcagaagcttcaccagaggtaatggaaaagcttctggaagaaaccggaaccattcaggacctgctggaacaacatgacttttatcagattgacacaaaagttgaagaaatcggccgtgccctcggcctgacagaaatcggtcttgaccgggatgttacagaactatccggcggtcagagaaccaaagtccttctcggaaaactgcttctcgaaaaaccggacattcttcttctcgacgagccgaccaactatctggatgagcagcacattgagtggctgaaacgctatctgaaggattatgataatgcttttattttaatttctcacgatattccatttttaaacagtgtcatcaacctgatttatcatatggaaaaccagagccttgaccgctatccgggagattatgacaagttccgggaagtttacgcaatgaaaaaagctcagctcgaagccgcttataaccgccaacaacaggaaatcagcgctctgaaagactttgtcgcccgcaacaaagcccgggtctccacacgcaacatggccatgtcccgtcagaaaaaactggataatatggacatcattgaacttgctaaagagaaaccgaaaccggaatttaactttaagacggcccgggcctccggcaaaatgatctttgaaacggacgatcttgtcatcggttatgacgagcctttgacctgtccgttaaacatccgaatggaacggggcgacaaaattgccctcaccggagcaaatggcatcggtaaaacaaccctcttaaagagtattcttgggctgatcccggcttattcgggaaaagtccagcttggcgattatcaatatatcggttactttgaacaggaaggagaaaaggacaatcggacaacctgc

SEQ ID NO: 2244 - DNA, 894 bp, Unknown
  Description of Unknown: Lachnospiraceae sequence
gcggaaggaaaaagggcagatcggccggcctttgtccgccgggcggcggtctgcagcagtacccaggtcgttgagattgacggtgtccgggtgatcggtgagcgaatcaatccaacgggtaaaaaactgtttaaagaagctttattaaatcataatattggttatatattgacccaggggatttcccaggtggaagccggagcccatattctggatgtgaatgtgggtctgccgaagattgatgaagccggattgatggtggaagtgatcaaagaacttcagggagtggtggatgtacccttacagatagattcttcccatgccggggttatcgaaagcggtcttcggatttataacggaaagccaatcgtcaattcggttaatggcgagacggctgtcatggaaaagatttttcctctggtcaaaaaatacggggcggccgtggttggccttacattggatgaaaagggcatcccgcttctggccgaagaacgttatgcggtggcggagcgaattgtccgaaaggcggagagttatggcataccgaaggaggatatctatattgattgtctgacgctgacagcttcggctcagcagaaggaagtcgtggaaacgttgaaggccatgcagcttgtcaaagagcggcttggtgtaaaaaccgttctcggtgtttcaaatatttcttttggattaccaaaacgggagtttgtaaatgtggcgtttttgacgttggctatggctcacggtctggatctgccgatcatcaatccgaatgtgtcggccatgatggcggcgatagacagttttaatgtcttatataaccgggatgaaggttccaggttttacgtggacaagtacagtaagattgtggaggcggagaaaaatgctcagtcg

SEQ ID NO: 2245 - DNA, 981 bp, Unknown
  Description of Unknown: Lachnospiraceae sequence
gtggatattcgacaattggaatattttgtggaattggctaagacaagaaatttccgaaaagcatcggaacatttgcatttgtctcaaccggcattgagtaagagtatccgtcttttagagacagaattgaatacagtattgattgagagaaccaataaaagttttgaattgacggatacgggacaggcgctgttacagaaatctgtatgtttgattgagcagtttcaggacatttacaagatgatcgacgacgtccggttatcgaatcaaggggagattaagataggcattcccaatattcttggttatttatgctattttgagctgatctgtgagttccagaagaagtatccgggaattaatatttctgtatccggagaggggacgaaagatatcaacgcggccctgagagaagaacgcttggacctgggaatgggcatgctttcggaaaacgttccgattgccagagacgtacaggtgataccactgactcacgatgaaggcgtggcagtggtccacaggagtaaggcctatgcagctgtggatgcaatcagtatccgggatatgaaagacgaaaatttcgttcttatgaacgaacagtatttgctctatgatgatattatgcaattatgtatgcaggcgggattcacaccgaatgtgacggcgaaaagcagccagtgggatttcccgctgatgatggtcgatgccaatcttggggtttccatactgccgagaccgttggtagaaaaaagtcctctgccggatattaaggcggtaaagattaaagagggattcaattgggatgtcggattcttttgcttgaaaaatcgcccgagaacgcatgcgatgaatcaatttatagaatttacaaaggaatatttgaaagaacataaggaatttcattatatctactatgcggatacgagtgtcgaatggagtggaaattgggattctgaagaatccaggattaaaaaaaattaa

SEQ ID NO: 2246 - DNA, 1074 bp, Unknown
  Description of Unknown: Lachnospiraceae sequence
acagatgagccagttacggatgaaccttctactatggaaccgtcaacagatgagccgattacggaaccatcgacaggagaaccttccacggaaccatcgacgggaacactgaaagatgatctaacaggcgctgtggatgtaaccgggccatccggcggagacagtggcggcgcttcatccggcgcaagttccggcggcggcactgcatcagaaacaccgacctttgcaccgaaaatgatcgttcagtcatgtaaatcttcaaaagatgaaattcaggccggagacgaagtgaccctggatattactttatctaatacgagcagtacggaaacagtcagaaatatgacagtgaccattggcgatgagggagagtatttgaatctgctcagtccgacagatacgatttatgtggagagtctttcggcgggacagacctgtgtcgtgtcatataaatataaaattctgtcatcagctgttccgggagcctatggcctgtcagtgtctatggattatgcggattcgaaaggggcatcccagtctgccagcggaaaaataagaatgatggtattccagtctgtgaaactagagttcgatccgttggtattgaattcggaggttcaggttggggatgtggtgatcgctcagatacaggcgatgaatcttggacggagcaaggtgcataatgtccgggcagtgattgaagcggatggcctggcgccggagggaacactttttatcggggatattgaagcaggaaaaacagcgacgggaagcgtaaaaatttctgtgaccagtttgtcaaaaggttcatcgttgtacggagagacaaagggcattgtgacctattactatgaagatgaaaacggaaaagaatatgaaaaaactggagactttataacgaatattaaaacgcctttttcaaatacgacagaggaggaatcggatgatacaggacaatggtggattattatggcagtcgttgtcggaattttatttttcttaatcattggtatgatcctgcatggaattcggcgaagaaacagacagaatgaagtggaggaaaaagccgaatga

SEQ ID NO: 2247 - DNA, 672 bp, Unknown
  Description of Unknown: Lachnospiraceae sequence
gagcaggaaaaaatgcggttatcctctcacattaatgatatggccatggctgaatttaaaaaactgattcatgaaggcatttccgaaaaagaggcagcagaccagatgatgcagatttacttaaatctgggtgcggatggattctcttttgaaccgttggttgcctttggagcaaatgcggccgatccccatcatgcgccggatgatacggtggtaaaaccaggtgatgcggtattatttgatgtgggctgcattaaagatggctattgctcggatatgacccggacattctattttaaagaggtgagtgagatacaccgacatatttatgatacggtgcggagtgccaatgagacagctatttcaaaaattaaaccgggtgttttgctgtgtgagctggacaagacggcgagagatctgatcgatgccgaaggctatggtccaaactttaatcatcgtctgggacatttcatcggcctcagtgaacatgagtacggcgatgtgtcctcaacaaatcagaacagggcggtgccgggaatgattttttccattgagccggggatatatctgaccggagatacgggcgttcgggtggaagacctggtgcttgtgacggaggatggatgtgaggtcctcaatcactattccaaagaacttgagattattggctaa

SEQ ID NO: 2248 - DNA, 924 bp, Unknown
  Description of Unknown: Lachnospiraceae sequence
gaccggattggcggcgaagtcaaacggattcagcaaacggctaaagcactggcaaaaacggatgtctatgcatctctggcctacgttgctgaacggaatcactatgtccggcctcagattaacgagaatggtattatagatattaaagacggacggcatccagtggtggaacagatgattccgaatgatgcctttgtaccaaacgatacatttctcgacaataatcaacgccgtgtatccattatcaccggacctaatatggctgggaaatctacttacatgcgtcagacagctctgatcgtactgatggcccagatgggttcctttgtgccggcagccagtgcgaatatcggcatttcggaccggatttttacccgtgtcggcgcatcagatgatctggccagcggtcagagtacctttatggtggagatgaacgaagtagccaacattctccggaatgcaacgaaggacagcctgctgattcttgatgagattggccggggaacgtcaacctttgatggcttgagtattgcctgggccgttgtggaacatatcagtgataagaaaaaactgggggcaaaaaccctttttgcaacccactatcatgagctgaccgaactggaaggaagactttcaggcgtaaataactactgtattgctgtcaaagaacagggggatgatattatcttcctccgaaagatcatacagggcggcgctgataaaagttatggaatccaggtggccaggctggcgggtatccccgcttccgttacggacagggccaaagaaatcgtcctgcagttgatcgatgcagatattgcggccaaagccagagaaattgccagtgaggaaggggcctgtctgtccgggccggaggaaacgccaaaggttgttgaggaggcagcctccccggatcagatggtc

SEQ ID NO: 2249 - DNA, 774 bp, Unknown
  Description of Unknown: Lachnospiraceae sequence
atgctctctttttgtttgctgaaagcgtggcttccatatttcattatcggcggtgcactggttatcactcgtgtgtggtccactttacagccggatagctgggctggcgctatgaagagctttaagatcacacttccggtaatcaactggagctgggcgattctgtggaatccgggagttattttcatcattgttgcgcttattacaattgctttgcataagatggatggcagtgctgttaaaacggcctgggctggttctctgaatcaggttaaaggcgctgcgatcgcacttttgtttggtgttgcgatggtttacatcttccgcaattctgcaaatgatagcgtcaccgttacatatatgatggatggagcatctaaagggcttggttctatgttgactatgatggctgacggccttggttctattttcagaggtgcatatattatcatcgcgccgctgatcggtgtccttggtgcgttcatgtccggttccaatacggtatcgaatacactgttttccggtctgcagtttgagacggcaaccatggttggcttgccgcaggttattatcgtcgcactccagaacaacggtggcgcaatcggtaacatggtttgtgtaaacaacgttgtttcggcgtgtgcaaccacaggtacgatgggtaacgaaggtaagattatccgtacgaactttgttccatgtattgcattctgtattgttgtcgttgtcgtatccttcattgttatgaatctgggattagtatctgtactctga

SEQ ID NO: 2250 - DNA, 1047 bp, Unknown
  Description of Unknown: Lachnospiraceae sequence
atgcagcattttgatagtgattatatggaaggcgcccatccggtcattttgcagcggctgctggagacgaatatggagaagacgccgggatatggaacagatatatattgtgagagggccgaaaaaaagattctggaagcttgcggctgtccggaggggaaagtctattttatggtcggaggtactcaggttaattctacggtcattggggctctgctgaaatcctacgagggagttgtggctgccgatacggggcatatcagcgtccacgaggcgggagccgtggaggcgacaggtcacaaagtgctgacggttccgggggtacagggaaaacttttgccggagacgttaaaaacatacatggaaacctactatggcgacgagaaccatgagcatatggtctggccgggaatggtgtacatttctcatccgacggaatatggtacgctgtacacaaaagatgaactggaaaagctgcatcagatctgcggtgaatatcacatgcctttgtttttggacggagcccggctgggatatggattgatggcggatggtacggatgtcaccctcagagatgttgcccggaactgcgatgtattttatattggcggaacaaaggttggagcgctgttcggagaagcagtcgttttgccaaaatccggatggattccccatttctttacaagtatcaaacaacatggcgcgctgctcgcaaaaggacgtatcctgggtattcagttcgattcgctttttacagacaatctgtattttgaaatcagccgccatgccatcgatatggctatgaaactcaagaaaggtcttttggaaaggggctatacactgtatatggatacggtgacgaatcaacagtttgttctgctggataacagccagttggaggctctggccggacaggtttcctgtggtttctgggaaaagcggccggatggccggacagtggttcggtttgcgacaagttgggcgacccgggaagaagatgtggatgaattgttagaaattttgggacaggtgagtagggatgtataa

SEQ ID NO: 2251 - DNA, 1368 bp, Unknown
  Description of Unknown: Erysipelotrichaceae sequence
gggaggagacaaaaaatggcaaaaaccgcaaatattactgaaggatcgatcgtaaaaccgctcttttattttttctttccgatcctgctggggactttttttcaacaattatataatactgtcgatgcgctgatcgtaggcaactttctcggcaaagaagcactggctgccgtaggcggaacaacttccacttatctcaacctgtttgtcggctttttcgtaggcctttccagcggcacgaccgttttgatctcacagtatttcggatcaaggaattatgaacatatatcacgtacggtacatacatccattgccctttctgttgtgatcggcgttctgttaagcattgccggtttcttctctgcccgcgcatcgcttgtctttctgaatgtgccggcggaaatcttagatctttctttgaattatatttatatttatttcatcggattgttcctgatgctcatctataatatgggatgtgcgatcctgcgtgcggtcggtgactccaagcacccactgtattttttgatagtctcttgtttcgtaaacatcgttttggatattctgtttgtttacgttttcggatggggcgtacgcggtgcggcaattgctactgttttagcgcaggccgcagctgcagccctcgttatgctctccctgtttcaaagtgatgatgccctgcatttttcttttcatgatctctgcatcgattttaagatcacaaaggatatctttaagatcggcttcccggctgccatcgaatctgttttatatacgatttccaatctgatcatcgccgccaagatcaatgacttcggtgttgatgtcattgcggccaataccgcctatggtaagatcgatgcgatctactggatgatcctgcaggccttcggtatttccattacgacttttgtcgggcaaaatttcggagcccgtaaatttgaccgtgtaaaaaaaggaatcaatcgctggatggctatcgccctcgcgatctctgccgtcctctctgtgctgatgatcttctttgccccgcagctgctgttactgttcaacaacgatccggcggtcattcgcatcggccgtcagatcatcatctggatcgttcctttctggtttacctatgttccgatcggtctgatgtccggcagtctgcgcggaatgggaaacacgctgatcccgaccatcatcaccgctgtcggcattatcggtcttcgttcggtatggatccttctgatcccgaatctgtctctgcagtctgtcttcatggtctatcccgcaacatggatcgtcacttcgatcgtcttcctgttctattactattccggattgtataaaaaaggcatcattcaggtttcaaacgctatatga

SEQ ID NO: 2252 - DNA, 1977 bp, Unknown
  Description of Unknown: Erysipelotrichaceae sequence
atggagaataaactgtttgaattggtttccggctatcagcctcagggcgatcagccgcaggccatcgatgaattggtcaagggaattcaggcgggaaaaaaggaacaggtcctgctgggggcaaccggtacgggaaaaacatttacaatttccaatgtgattgccagagtgaacaaaccgaccctggtgtttgcccacaataagacactggcgggacagctgtattcggaattcaaggagttttttccgcataaccgcgtggaatattttgtttccaatttcgattattatcagccggaggcatatcttccgaatactgatacgtatattgataagaatgcaacgacaaatatcgagctcgacatgctgcgtatggctgccgtcaattcgatcctggaacgaagagatacgatcatcattgcttctgttgcctgtatttacggcgcaagcaatccggaacagtaccgtgatatgtttttctcgctgcatgtgggagatgtcattgaccgtaaaaaactgatgcagcgtctggtggcacagcagtacactaggaacgatatggatctgagcagaggaacgttcagggcccgcggcgatgtgatcgagattgcgccgggccatacagatgctttcatcctgcgtatcgaattgtttgatgatgaaatcgaacggatctgtgaggtggatccgctcagcggcaagacattaaatgcatattctgtttacgttgtttatccggccagcggttatgccaccagccaggatatcatcaaccgggcggcagacacgatcgaggaagagctggaggagcggctgcagtattttgaacaggaaggaaaactgctggagaagcagcgattggaacagcgtacccgctatgatgtggaggcgctgcgccagttcggcgtatgtcccggcattgaaaactattcccggcatatcgacggccgccgaccgggggaacgtccgtatacattgtttgattattttccggatgattttctgctcgttgtcgatgagagccatgtgtcccttccgcagatccgcgggatgtataacggtgaccgttcccgcaaggaaacgcttgtcaacttcggctttcgtctgcccagcgctttagacaaccgtcctctgcgtttcgaggaatttgagaagatggtcaatcaggcaatttatgtttcggcaacaccaggcgattatgaattggaaaaggtacacggcgaggtcattgaacagatcattcgtccgaccggtcttctggatccgatcgttgaagttcgtccgacaaaaggacagatcgatgatttggtcgatgagatccgcgaacggatcgaacgcaatgaacgcacattgatcacaacgctgacggtgcggatggccgaagacctgaccgcttatctgaaaaatatggattttaaggtggcgtggcttcatcatgaagttacgacgatcgaacgtacggaaatcatccaggatctgcggaagggaaaatatgatgtgctggtcggcatcaacctgctcagagagggactcgatattccggaagtctctttgattacgatcctggatgcggataaagaagggttcctgcgcagcgaacgttctttgattcagatcatcggacgtgcagcccgcaatgcccagggaaaagtcatcatgtatgccgatacgatcacgcagtcaatgcgcaaagcgcttgatgaaactgcacgacgccgtgagatccagatggcattcaatgaagagcacggcattacgccgaagaccattatcaagccgatccatgatgtggtccgcagcaaggaaacaaaagaaatgacagcggcttacatgaagaagaaaaataaaatggcgaagaaggacaagacaaagatgctggagaatatcgagaaggaaatgaaggaagcagcacgcgtgctggatttcgaacgtgcggcacagctgcgcgatatcctgatcgaactgcgcaattcttaa

SEQ ID NO: 2253 - DNA, 1725 bp, Unknown
  Description of Unknown: Erysipelotrichaceae sequence
atgagcatgaaagaagtattgaaaagactgatcgtatttttatggctgttcaaaggcctgctgatcttctcattgatttgtgcgtttctgtctgtctttttgaacgttgcggcaccgatgctgatcggcagcattatcgatcagatcacaggatcgctttcgaaacagcagctgctctctgatatcgtgcttttgatcgttctttatattttgtattctttgtttaactggggcatgatggccgccagcaatcgcattgcgttttccagcagcagtgtgctgcgccggcagctgtatgagaaacttgaaaagctccctgtatcgttttatgatcaaagcacccgcggtgatttgatttcccgctttatcaatgacattgatttcatcagcgacggttttctgcagggattatcgacaatgctcagcggtgtggcaaccattgtgctgaccctggtgttcatgctgcagatcaacctcatcatgacagccattgtcgtcatttccgctccttttacttatctggttgcccgtgtcattacgctgcggaccaaccgttatttcaatgagcaggccaatattctcggaaagctgaacggatacagcgaagaaatgctcagcggcattaggaccgttaaagcatacggatatgaagaagatgctcagcggcagtttgaagcgtataatcagcagctgtatacctccggtgtaaaatctcagttttacggttctctggcgaatccgagcacgcgctttgtcatgaatacagcgtatgccatcgtcggtgcgatcggtgccctgcttgcctttttctcccagatcacgatcggtaacatttccacttttttgatctactctaatctgttttctaagccgtttacggaaatcaccggtgtcatgacacagctgcagagcgcggtgtccagcggcaaacgtatctttacgatcatggatctggaagaacaaagcgatgacagcgataaagatgtgctgaacctcaaaaaaggggaaatcgatttcgaacatgtatcgttcgcttatgatccgcagaagccgctgatgaaagatatcgatctgcatgtcaaagccggcagcaaggtggcggtcgtaggaaagaccggagccggcaaaacaacactggtcaatctgctgatgcgtttttatgacatcagcagcggctgtatccgagttgacggccatgacatcaacacagtgacaagagactcgctgcgttcttctttcggcatggtactgcaggatacgtatctgtttgaagggacgattgcggaaaatatcgcctacggaaagccggatgcttcccgtgaagcgatcattgccgccgcaaagaaaagcggggcccatgagtttatcattcgtctcaacaaaggatacgatacggttctgcacggcaacagcagtattctttcgcagggtcagcggcagctgctatcgatcacccgtgtcctgctgatgaatccgcgtgtactgatccttgatgaggcaaccagcagcatcgatacggtcagtgagcagcatgtcaaccatgcgatgcatctgctgatggaaggaaagacaagctttatcattgcccatcgtctgtccacgatcattgatgcggatctgatccttgtcatggaacagggcaatatcatcgaacagggaacacatgaagaactgctgaacaaaaacggagcatatgcccagctgtttaacagtcagtttgcctga

SEQ ID NO: 2254 - DNA, 1221 bp, Unknown
  Description of Unknown: Erysipelotrichaceae sequence
atgatgcaaatcagaaagttgatggcactgggctgtgctgcggccatgctgtttgcgacagccggctgtcagggaaaagacccgcagggcgaacaggagaaatttgacgcctttattgaacaggaatttgtcgatgcaatggaaggaaactatgtcaatgcacatgtttacatgcaggatccggaaagctttggcgtagatgcttccaagacggaggtcagtctcggttcgcgctttgatgaggcgacatttgatcaaagcagagaagcttttaaggaaagctatgatgaattcaagagctttgatcgtgaactgcttaatgatgaacaaaaggatctttatgataattatgcctttgaagcggaaatcagcgaacagctgatggatgagaagtttgattattacgaacagttgtttcaaagcatgagcggtctgcagtttcagcttcctactttgttttcagactgggatatccgcagcgaacaagacgtaaaagatctgatcgtgctgctgcaggatgtgcatccatatatcgagagcgctttggaatatacgaaaacacaggaagagaaaggtctgttgatggtagatgcggaatcggtcatggactattgcaaagacattgccgatgcaggtgcggaaagctcgatcctgaaggcaatgcaggaaaaggtggatgagctcgatctggatcaaaagcggaaagacagttataaacagcagctggaagatgcgtttgtttcttccttcattccggcttaccaggatatttattcagtgatgaatgaactgaaggacgctgacggcaacaacaaaaaagggctggcagcttttccggacggaaaggaatattttgaacttctgctgacacagaacatcggttcagacaagacagtgaaagaagtaaaagaaatgatgaacgatgcctatgaaagtcatctgacatcgctgcagatgatcgcgtttgccgatatggatgcgttggaaccgcttttaaatgaggagctgccttctaccggctatcagaattatgatgagatcctgaacgatgtcagcgaacgcatgacgcaggattttccgaaagtgtctgatttaagctatcatatcgaaaatatgaacgaagaggtcgcaactgacggcattgcggcatatttcaatgttccgccgatggatggaaatgcgctgaagcagctgagagtcaatcccgacggagcagatccg

SEQ ID NO: 2255 - DNA, 1986 bp, Unknown
  Description of Unknown: Erysipelotrichaceae sequence
atgaaaaaatggatgaattatctgccatatgcacttgtgatcattattctcgcctcacttattgtattcagcaatgacagcaggacgcagaattttgattattccacgttcatgcaggaagctgagaaaatgactttccagcagtcttcaatgtctgtgggcagcactgtgattgatgtacagggtacctataagaatgaagacggaacaacacgcaactttacagtaagtgtgccgaaaacagatgagaacatacagtggctgacggatacactgggagaggggaagatcgcagtatctgatccgaaccgtgaaaatcagttcatcaatgtgctttttaacctgcttcccgtactgctgatgatcggagctttctttatcattttttccaagatgaatgccggaggcaacaacaaggcctttgattttgcaaagtcccgtgccaagattcaatcaaatgtgaaggtacgattcaaggatgttgccggctgtgatgaggaaaaagaggaagtccgtgaaatcatcgactatctgaaaaatccaaaacagtttacggatatgggagcccgtatcccgaaaggtttgttgatggtaggtccgccgggaaccggtaagaccctgcttgccaaagctgtggccggagaggcagatgtaccgttcttctcgatcagcggttctgatttcgtggaaatgttcgtcggtacaggtgccagccgtgtccgtgacatgttcaagaaagcacagcaggctgcgccttgtatcgtgtttatcgatgaaatcgatgcggtcggacgccagcgtggtgccggcatgggcggcggcaatgacgagcgtgaacagacactgaaccagctgcttgtagagatggacggaatgggcgaaaacaaaggaatcgtcatcatcgcggcaacgaaccgtccggatgtattggatccggccctgctgcgaagcggccgttttgaccgccagatcacggtgagtcttccggataagaaaggacgcgaggcgatcctgcgtgttcatgcccgcaataaaaagctggccaaggatatctctttggaaagtcttgcacagcgtacacctggcttttcaggtgccgacctggagaatgtgctcaatgagggtgcgatcctcgcggttcgtgatcatcgcaaaatgatcacgatggatgacctggatgaggcaattgaccgtgtcatgatgggaccggccaagaaatcgaaaaaatacaatgatgatgacaagcgtctggtttcttatcatgaagcgggtcatgcggtcatcggaatcaagctgaaagatgctgatatggtacaaaaggtgactatcattccgcgcggggaagccggcggctataacctgatgacaccgcgggaagagaaatacttccatcgcaagcgtgaatacatggcacagattaccggccttttaggcggccgtgtggcagaagaaatcgtattcggcgagatcagtgccggtgccgtgaacgatatcgaaaagatcactaagattgccaaggcaatggtacgtgtcttcggtatgtcatcactgggaccgatccagtatgcggatccgcagggaaatgttttccttggacgtgactacaacaacggcaacaactattctgccggcgtagctgccgaaatcgacaaggaagtccgtaagatcgttgacgagtgctatgaggactgcaaacgcatcctgagcgaaaaccgtgatctgctggatctgatcgcaaattccctgtttgaggaagaaacgctgacaaaagaacagatcaacaatctggttgaatacggaacattgacttctccgcaggaggaagctgaaaaagtgcagcaggaacagcctgtggaagagacgccgaatgaaggagaggcttctgacgataacggacaggagacttctgccggtaatgaacccgaagaacctcaggtttcagacgaagaaatggaagaagctttaaaagagctgacaaaacattga

SEQ ID NO: 2256 - DNA, 1587 bp, Unknown
  Description of Unknown: Erysipelotrichaceae sequence
aatccgtctgtcgaagaggcagagaagagtgatatctcattaactgttgccggtacaaaaaatgcaatcaacatggttgaggcaggtgccaaggaagtcagtgaagaggatatgcttggcgctttaatgtttgggcatgaacatatcaagcagctgtgtgcattccaggaagagatcatcgcggctgtaggcaaggaaaaacgtgaaattacattgtatacaatcgacgaagcattaaatgcggaagtacgtgaaaagtttgaacatcagattcgcgccgctgtttctatcgaaaagaaactggaacgctacaataaaattgatgagctgacggatgaagccgttgcgatgtttgaggcacgcgagtacgaaagcgaaaaagagaagaatacggccatcaagcaggtgaaggaaatctgccattcaatcgaagcagatgaagttcgccgcttgatcatcgaagataaggttcgtcctgacggaagaaagatcaatgagatccgtcctttggattcacaggtcgatctgctgcctcgtacacacggaagcgctatgtttactcgtggtgaaacgcaggttttaagtgttacgacactgggtgctatcaatgataaccagatcatcgacgatctgacagaagttgatacaaaacgcttcatgcatcactataacttccctccatattctgtcggagaaacaggaagaatgggaagtccgggacgccgtgaaatcggtcatggtgcattgggagagcgtgcactgctgcaggttctgccttcattggaagaattcccgtatacaattcgtacagttgcggaagttttagagtcaaacggatcctcatcacaggcgtccatttgtgccggaacaatgtctttgatggctgccggtgtaccgatcaaagctcctgttgcgggtatagccatgggacttatcatggacgagaacagcggtaaatatacggtacttacggatatccagggtatggaagaccattttggcgatatggactttaaggttgccggtacagaagcaggcattactgcactgcagatggatattaaggtgacaggaattacaaaagagatttttgaagaagcgttggctcaggcaaaagttgcccgcaaggagattcttgctaatatgatgggtgcgatcagtgaacctcgtccggatgtaagcccatatgcaccgaaaacacatatcatgcagattaaaaccgataagattaaagatgtaatcggtccaggcggaaaaatgatcaatcagatcattgaagcatgtgacaatgttaagattgatatcgatgacaatggacaggttgttatttatcatagtgaccgtgaggcaattaataaagccgttgccatgattgaagatatcgtgcgtgaagcgaaggtcggtgacatttacgatgcgacagttgcccgtattgaaaaattcggtgcgtttgtcacgttgttcccgggaactgacggactgcttcatatttcgaaaatttctcataaccgtgtagatcgcgttgaagatgtgcttaaagtcggcgataagatcgaagtaaaagttatggaaatcgacaataaagga

SEQ ID NO: 2257 - DNA, 1230 bp, Unknown
  Description of Unknown: Erysipelotrichaceae sequence
atgaacgaaaaggtattcaatatgaacgaaaaccctttaaagcagattattgcgaaacaaaaggcaggcgaagccgtcggcatttactctgcctgcagcgccaacagctatgtaatcgaagctgcaatcgaatgcgcaaaacgggataattcctgtgttctgatcgaggctactgcaaaccaggttgaccaaaacggcggttacactggcatgaagccggttgatttccgtaactttgtttacgagatcgctgaaaaagtcggctttacaaccgatcgcatcttccttggcggcgaccatctcggtcctctgactttcgcatcaaaaccggaagcagaagcaatggcggatgcacgtgaattagttcgctgctatgtggcagccggattcacaaagatccatatcgataccagcatgaaggtagcggacgatgatccgaacgttcgtctgagtgatgaaacaatcgcacgccgcggtgctgagcttgcccgtgtatgcgaagatacatatcaggaactgctgaagacaaatccaaatgctgttcgccctgtttatatcgtgggaagcgaagttccgattcctggcggggcacaggatccaaatgccggcatgcaggtaacccgcgtagaagatttcaaggcaacagtaactgcattcgaaaaagcatttaaggaagccggtctcgaagaaacatggaaagatgtcatcgcatgtgttgttcagccgggcgtggaagaaaaagatgccggatgtacagaatatgaccgtgcgaaagcagctgagctgatggcaagcatcaaggaattcccgaaccttgtattcgaaggacattctactgactatcagacgaaattcaaattaaaagaactgatcgaagacggtgtcggcatcctgaaagttggtccgggcctgacttacgctatgcgtgaagcactctttgctttggcttacatggaaaaaatgatcatgcacggaaatgaagaagaacagtctcacttcatcgatgtactggaagaagcaatgctcgcagaacctaagaactggcagaaacattaccatggaaatgacaacgaactgtggttcaaacgtaaattctcattctctgaccgcagccgttattatatgcctgtaccggaagtaaatgcagcaaaagaaaagctgatcgccaacctgcgcaaatacggcgtatcactggctgttctttcacagttcatgccgatccagtataca

SEQ ID NO: 2258 - DNA, 1320 bp, Unknown
  Description of Unknown: Erysipelotrichaceae sequence
atgtacaaacaaatatcagaggaattactgtcttttatcagaaagagcccgacctgcttccatgcggtggatacgattcgttccatgctgaaagaagccggttatcaggaactgaaagaatgtgaagcctggaatctgcagacaggcggaaaatactttacgacacgcaacggttccagtgtaattgcattttcgatcggaaaagagcttgatgactatcatttccagattgcagcttctcacagtgattctccgacattcaaaattaaggaaaacgctgaactgaaaggaaagggcggctatattcagctgaacacagaaggatacggcggaatgatctgctctacgtggatggatcgcccattgagcattgccggtcgtgttctggtcaaagaaggcaatgctttggtaacaaaactggtttcatttgaccgtgatctggttttgattccgaatgttgcaattcacatgcagcgtaatgtgaatgacggaatggcgtttaataaacaggttgatatgctgccattgttctcagccggtgaatgcgaggacggcgatttctatcgtctgatcgctgaagagctcggatgcagccgtgaagatatcatgggaacagacctgttcttggtaaatcgcatgcagccaagcatctggggaatgaaagaggaatttatctcaagccctcagctggatgaccttcagtgtgcctttacttctttaaaagcaatgctgacaggagaaaatgcacacggcatcaatgtttatgcatgctttgacaacgaagaagtcggttccggaacaaaacagggagcactttctacgttcctgagcgatgtgttgaaccgcatcaacgaaaatctcggatttacaaaagaggagctctgccgtgcagtcgcaaagagcttcatggtttcatgtgacaatgctcatgcagttcatccgaaccatcctgaaaaaacagatgcaaacaactgcacatatatgaatcagggtatcgttgtaaaatatagtgctaaccagaaatatacaacagacggcatcagttccgcagtattcagcgatatctgcggccgcgctgatgtgccggtacagcgtttcgccaatcgttccgatatggtaggcggaagcacactgggaaatctgtctaaccagcatgtgtctttgcatacagtggatatcggtctgccgcagcttgcgatgcattcagcatatgaaacagccggcatcaaggatactgcgtatatggtaaaggcgctgcagaaattctataacatcaatcttcacattactgacagtgacatgattgaggttcaggaataa

SEQ ID NO: 2259 - DNA, 1620 bp, Unknown
  Description of Unknown: Erysipelotrichaceae sequence
atgatggcaaaagaagtacgtttttcaaaagatgctcgtgaatcaatgctgaaaggtgtcaatattctagcagatgcggttcgcgttactttaggtccaaaaggacgtaatgtggtattggagaaagaatatggttctccgctgattacaaatgacggtgtttccattgcaaaagaaatcgaactggaagacaagtttgagaatatgggcgcaaaactggtatatgaagttgccaataagacgaatgatacagccggtgacggaactactacagcgacgattcttgcacagagcatgatcgaaaacggtttgaaagcagtagaaaaaggcgcaaatcccgttttgatgcgtgaaggaatcgaaatggcaagtaaagaaattgcaaaacacattttagagaaatcacgcaaagttgaaacgggaaatgatatcgcttccgttgccactatttctgccggcagcagtgaagttggtgaaattattgcagaagcaatggataaagtaggccgtgacggagtgatcagcgttgatacgtcaaacggttttgaaacagagcttgaaatcagtgaaggtctgcagtatgacaaaggatacgtatctccgtatatggtaagtgaccgcgaaaaaatgcaggtggaaatggaaaatgcctatgttttggttactgatcagaaaatcagtaatattcaggaaattcttcctttgttggaacaagtactgcagtcaaacaaacctttgctgctggttgctgaagacttcgagaatgaagttgtctctacactggttgtgaacaaactgcgtggaacattcaatgtagttgcaacgaaagctcctggatttggagataatcagaaagaactgctgcaggatattgccgtactgtgcggtgcaaagttcttctctaaggatctgaacatggatttgaaagaagcacagattactgatcttggtcaggttaaaaaactcgttgttacaaaagacaatacgacgatgatcggtggttctggtgataaagcggcagtagaagagcgaagcaatgaaattgcggcgcagatcgaaaacacaaagagtgattatgacaagaaacgtcttgcagagcgtcttggcaagctgaataacggtgttgctgttattaaggtcggtgctgctacagaaagcgaactgaaagaaaagaagcttcgcattgaagatgccctgaacgcaacacgtgcagctgtcagtgaaggtattgtcattggcggcggggctgctttggttgaagcatatgtggcattgaaggaccagctgaaatctgatattgtagatgttcaaaagggaattaaagtagtttttgatgcactgctcgctccaattgctcagattgccgaaaatgcaggttataatgcagaagaaattgtagatgcacaaaaacatgcagaagaaaatatcggtttcgacgcaaaggccggcaagtgggttgatatgtttgaaaaaggaatcatcgatccgacaaaggtaactcgaagcgcattgctgaatgctgccagcatttctgctttgtttattacgacagaagcgggcgtagcggcaattaaagaagataaccctgcaccgatgatgccacagggcggaatgtattaa

SEQ ID NO: 2260 - DNA, 1398 bp, Unknown
  Description of Unknown: Erysipelotrichaceae sequence
atgagagaaaatccattgggttatgaaaaaatatccgctttgctgcgaagtttcgcccttcccagcataacagcgatgctggtgagctcgttatataatatcgtcgaccagatctttatcgggcagggtgtcggatatctgggaaatgccgcaacgaatgtgtcttatcccctttctacgatctgtctggcgatcgctttgctgatcggtatcggcagtgcatcacgcttttccatctgtctgggaagaaaggaatatgagcgtgcggcttcgctggtgggaaacgcgatcatcatgatgacggcttgcggtgtcctgtattttgttgcgggagaattgtttttgacaccgctgctgcgtatcttcggagcaacgaaggaagtcatgccgtatgcgaaagaatatgcgggaattactttgatcggtatgccgtttcttatcctgaccaacggcatcagtaatcttgtccgtgcggacggcagcccgaaatattccatgttctgcatggtggccggtgccattgtcaatacgatcctggatccgcttttcatcttcgtatttcactggggcatcttcggtgcggcactggctacgatcctgggccagatcctgtcttttttgattgcgtttcgttatctgttctgcttccatacgattcgcctgaacaaaaacagctttcgctttcatctgcgcgataatctgcgtacgatgtacatgggaaccagcagctgtatcaatcaggtggccattacgtttgtacagattatcctgaacaattcactgacttattacggggccctttccgtatatggggaggacataccgcttgcggcatgcggcattgtcatgaagacaaatgcgatcctgctttcgatcatcgtcggtatttcccagggcgtacagccgatcatcggctataactacggtgccgccaagtatgcgcggatccgggaggcgttcctgctggcgatcaaatggaattttgtcgtatcgatcatcggcttctgcctgtttcagttctgtacatatccgatcatctcgattttcggcagcggcgatcagctgtattttacctttgcggtttcattcatgcgcatcttcctgttcatggccattgtcaacggtgttcagcttctgtcttccaatttcttcacggcgatcggcaaggctttgaagggacttttgttgtcgttgacaagacaggtctttttcctgatcccgctgatcctgatcctgcctttgttcttcggcatcaacggtattctgtttgccgggccgattgcggattttatcgcattcgcggtatctgtcatctttgtctggagagaattttgtcatttgaagcggctggaagaggaacagaaagaaaaagatgcatcagtaactgtcacagcttag

SEQ ID NO: 2261 - DNA, 1938 bp, Unknown
  Description of Unknown: Erysipelotrichaceae sequence
ggcgaaagcatatcaaaactagacaatatcaagctgaagatccaggaaatttatctcagtctgctgacagagcaaagcatcagtaagagagatatcctggtcaactatctgaatatgatctggtttggaagcgacggcggtacgcgcggcgttcagaatgcggcactttattatttcggcaaagatgtcaatgaccttaacctttctgaatgtgcatttctggccggtgtcatcaatgccccggttgcctatacgccatacaacctgactggcgacagtagcaaccattacgaaaacgcaacaaaacgacgcaacgaaacccttgccatgatgctgcagcacggctacatcagcgaagaagaatatcaactggcaaaaagtacaaatcttgcgttccagctggcaaagaccgaatcattcggcgcggatccatatcagagcgcggtagagctggcagttgaggaagcacgtacgctgacaggcaaagatccgtatacaaccgaaatggatatttatacaagcattgattccgatgcacaaaaaacagcttatgagctgagcgtgggtgatatcatttccttcccgaatcagtatttcaacgtcgggctaagcgttattgacaatgataccggtgagattatcgcaatcggaccgggacgtgaatacgtaggagattccacaagccgaaacgcagctacagagccacagcagccgggttcaacaatgaaaccgattctcgactatgctccgacttttgatctgctgggctggtcgacgacacatacagtggatgacaaagcagatgactactttaacataggcagagatctgcaaaactcagacggcaagtatctcggcaagatcacattggcggatgctcttggtctttcacgaaatacaactgcggtacaggccttacaggatctgatcgatgcacagggcagcagctactggatccagtacctgaaagatctcggcttcagtgacagcgttgctgaggcattcaacctgcagtatgctatcggcggaagcgatatgcgctgtacaacgattcagctggcttctgcatattctatgtttgccaacggaggaaaacgtacagaagcacattgtgtgcgtgaagtatccgtacgaggcggggaaactttcaagaccagcgccgaatccaaacaaattatcagcgatggtgccgcattcatgatgtcaaccgttttggaaaaggtcgtaaacggcggctatgcttcgtttaactacatccttgacggtgacggctcctatccggtatacggcaaatcaggaacgaccgactggggcgatcttggtgcacaatacggcattccgactaccgcaatgaaagatgaatgggccgttgcctacaccagcgaatacagccttgccgtatggagcggatttacgacgaccggtatcgaaaacggctattacattacagattccattctgtatgaagcaatcgcttctcatgtcgcaaggacgatgctggatgaagtaacggaaaatgcaacggatatccagcgtccaagcacggtttccgacaaagcaagcggagacggcggctatattctctccaaatactacaatacggaagaaagccgtacaaaaggtctgaaggatgatccgaagggtaccagcagcgaagaaaaaagcgagctggaagaaaaatgcaaggcagatccgacagttgacgagcgatgcgacggatacgaagaagcaatgaagaaaaaagaggaactgaaaaccaagtgtgctgcggatccaacgtatgatccgagctgtccgggctatgaagaagcaatgaacaaaaaagaggaagaggagaaaaaggccgcatgtgaagcaagcggcggtacatatgagaatggtatatgtacacctccagatacaaccaatcctccgacagatgaagatgatgattccact

SEQ ID NO: 2262 - DNA, 861 bp, Unknown
  Description of Unknown: Erysipelotrichaceae sequence
atgtcaattgcgtttcgacaagtagagcatacatacaatccgggaactccctttgcctatgccgcattgaaaggaatcgacctggaaattgaagaaggcaaagtgactgccgttatcggagaaaccggaagcggaaaatcaacgcttgttcagcatttaaatgcattgctgctgccgacaaatggagaaatcgaggtttgcgggaaattgatcaaatctaaggagaaaccgaaaaacctaaaggaactgcgtcggaatgtcggtctggtgtttcagtttccggaatatcagctgtttgaagaaacggtggaaaaggatattgctttcggtcctaaaaatttcggcgaaaaggaagaggaagcggcagctactgttcgccgtgtccttccgtatgtcggattgagtgaagaatatcttcggcgttcgccttttgaattatccggagggcagaagcgtcgtgttgcaattgcgggaattcttgcgatggatcccaatgtgctggtacttgatgaacctacggccggtcttgatccgcagggagccagagaaatgatggagctctttgttcggatgaataaagaattccataaaacagtgcttttggtaacacacgatatggaacatgtcctgaactactgcgatcatgtggtagttgtgcgggacggtggtatttgctgtgcacagaatgttcaggatttttttaaggatatttccatattaaaagaacttcgcattacaccgccggcaattattcgtatgcgtgaggaattaaatcagcggggatttcatctgtccaatgatcttctttccattgaagagctggcaaaggccgtggcaagtgaggtgaagtctcatgaataa

SEQ ID NO: 2263 - DNA, 1032 bp, Unknown
  Description of Unknown: Erysipelotrichaceae sequence
cagacgcagaaaaagatttatgcgaaaaaggcagaggaaagaatgtatccggcatctatgacaaagatgatgggactgctgctagtatacgaacaaattaatgacggcgctttgaaactggatgatcgtgtttgtgccagtgagacagctgcatcgatgggcggttcgcagatttatctgaaagtgaatgaggaaatgacagttgaagatctgctgaagagtgtctgcattgcttcggcaaacgatgcgatggttgcactggcggaaaaggtaggcggaacgcatgaacagtttgttttgatgatgaatgaaaaagcgaaagagctaaagctgtgcaatacacattttgtcaacgcgaccggtctgcatgacgatgatcattacagctgtgcgaaagacatggcaacgatcgcggctgcactgatcaaggaaggcggagaagaactgctttcgattacgtcaacctacgattcttatattcgcgaagacagtgatcagaaattctggctcgtaaatacgaataagctgatcaagcaactggatggtgctgacggactgaaaaccggattcacttctgaagctggatcctgtattacggtcacggccaaacgaaacggtcttcgactgatcggtgttgtgatgggggaaccggatgggaaaaccagaaatcaggaggcctcacagctgatcgaatacggtttttcgggatacgaatctaaacagctgtatgccaaaggagatgccgttgatgagctgtgctgtgagaaaggaacgcccgtcaagacaaaactgttagcgttggaagatgcttattatgtcgtgaaaaaggggacggattccaaagtgaaggaaaagcaattgcagttgactgatcatgaactgccgtatcaggcaggaaaagaatgtgcaagattaaaagtgatgatggatgatggttacacttttgaggtttctcttggtacagctcaggatgtccagccggcttcctatgtggatctgttgattcgctcttttcgacagatgatcgcatga

SEQ ID NO: 2264 - DNA, 1503 bp, Unknown
  Description of Unknown: Erysipelotrichaceae sequence
gtcaaaaaagcaaaggaagaagcatatttcttccgtatgcagaaatatgcggaccgtttgatgaagtacattgaagatcatccggaattcatccagccggagtcacgcaaaaacgagatggtcaacaacttcctgaagccgggcctgcaggatctctgtgtttcccgtacatcattctcatggggaattccggtcgattttgatcctcgtcatgtcatctatgtatggatcgatgccctgacaaactatattacttcgctgggctatgatgcggacggcaatcacggtgaaaactttaagaaatactggccggcagatgtgcatatcatcggcaaagatattctgcgtttccataccatttactggccgatcatgctgatggcgcttgatgtgccgctgccgaaacaggtattcggacatccgtggctgctggtcggagacggcaaaatgtcgaaatctaaaggaaatgcgatttatgcggatgatctggtacattatttcggtgtggatgccgtacgttatttcgtactgcatgaaatgccgtttgctcaggacggaacgatcacatgggatctggtcgttgagcgtgtgaattcggatctggccaatattctcggaaacctggtcagccgcacggtttccatgtcaaacaaatacttcggcggtgtcatcagtaatccgcaggtgaaggaagatgtggatgacgagctgattcagcttgctttggaaacaccgaaacgtgttgaaaagaaaatggatgaactgcgtgtcggtgatgcgatcgatgagatctttacgctgctgcgtcgtacgaataagtacatcgatgaaacaacaccttggatcctgggcaaagatgaaagcaagaaggatcgtctggccacagtattgtataacctgttggaaagcatccgttttgcggccgtgctgctggaaagctatatgccgcagacaagcgagaagatcctcgatgccctgggaacaaaacagcgtacgctggaaagcctggaaagcttcggtaatctggagacaggcggcagcgttgtgaaaaagatggaaatgctgtttgcccgtatcgatgccgaagaattcatgaggcagctggaagcggataaggaaaaagaggcaaaggcgcaggaacaggccgaagccgaagcgaaaaaagagacaaaggaactgatcacgatcgatgactttgccaaagtggaactgaaagtgggaactgttgtctcctgtgaaaaacatccgaaggcagaccggctgctggtggaacaggtagatctgggagatgagacacgtcagatcgtcagcggtattgcgaaattcttctcaccgcaggagatggtcggacgtaaggtcatcgttgtcagcaacctgaaaccggcaaagctgcgcggagtggaaagccagggcatgatcctttgtgccgcatccgatgatgacagtgcactggatctggcaaccatctgcaaagatcttccaaacggtacgacagtaagataa

SEQ ID NO: 2265 - DNA, 1389 bp, Unknown
  Description of Unknown: Erysipelotrichaceae sequence
atgaaaataaattggaaaaagcatgctgtattttcattgctgcagacatgcacatcatccatggctgcaggtgttcagttgactgttcggatgacagacagtttcatcatagaagatacgcgcggtctgaaagtgcgtttaattcgtcaggatggagggaacatcgaaagaaaactggtctttgatcacgggaaagctgttgttgatatgaatcagctggcctatggatcatatacgctgaccattgtatatgacgacgggacaccgctgacacgtgatgcggaggagaacagcgtatataaggtagacggaacgatcagtgaatatccatatgcatcatttcagttgacggacagtcatggtttttgcaaaatcgaaacagaactgcggggaaagtgcgggatactgacgatacatgttcttgaaagtgatgcacaaggtcagcggatgccttcaggagatgcagtttaccaatatgaatttgtgggaaaacgtttccgccaatgggtggaactgaattcgtgcaataattatgaaacgacggttgaactgcctcaggacatgtatacgcttcatcgtcacaatgaaacgagcaggatgatatttgatgattcacctgtaaccgatagctttgaaattgcaggaggtcatcattcgttcgccgtcattgaaacagtggacaaagtccctgatctggatctgaaagtatttgtgatggatgaaaagtgtgtgttgacgacaccgaaagattgttatttccaagttaaagtcagtggtcccgattatgcgcaaacaatcagcttgaatgaaatgaatgatttttccagtcagtttttcgatcttccattgggaacgtatacgattacggcacaccaggcgtgcggatatacagttctttatgaagtagatggtgaaacatgcagcgaatgtgtatttgatttggaaaataacggattgaatctgaatatagacattatttatcagcgggaagatatgatatcgcggccttcgcttcgcatccgtaaactgatcaaaggggaaagcggatgtctgatgccgccggaaagttcgcaaagcttttctgtttcagtatgcggctgtcaaagtacgcatagtttctatctcagcagcgaaaactgtttctgcgctgaactggcctgtctttgtccgggaatctatcagatcgaagaacaggataatcctgattaccttgtttcttatcagctttcagatggtactcctttaatagacgggagggtgatcgtcgacggatgtgaaggattagaggtatggatcatcaatgaacacaaaaatagtggtaaacttcagatttgtaaatatgtcgaagacgaaaacggaaatctgacttcgccgcaagcaggtgaatgt

SEQ ID NO: 2266 - DNA, 849 bp, Unknown
  Description of Unknown: Erysipelotrichaceae sequence
gaagatgaattcgaacataacttctacagtgccaaaagtgaagcaaaagcatgttttggtgacgatgatgtatatatggaaaaatatatcgagaatccaaagcatgtggaggttcaggtgctctgcgatgaatatgggaactgtctgcatctcttcgagcgtgactgcagctttcagcggcgcaatcagaaaatgatcgaagaagctccctgccatgcactggatgatacgattcgacagaatatgtttgaagatgctttaaaaccctgccgctatgtcggctacacttctgcaggaacgatcgaatttctgctttccagtgacggaaaatattatttcatggaaatgaatacaaggatccaggtcgaacatccgatcacggaacaaatctgcggtattgacattatcaagcagcagatcaagatcgcggatcatcagcgtctgaacttaaaacaagaagatataaaggcaaacggctatgcgctggagtgccgcatcaatgcggaggatatccgtcgggattttgcaccgtctcccggcgtgatcaaattcatgaatcttccctgcggaagaggagtgcgcgtggaaacagccgtttacaacggatacagcattccgccgttctatgattcaatgatcgccaagatcataacttttgcgccgacacgcctggaatgcattaaaaaaatgaggatcgctttggaagagctgatcattgacggtgtggagaccaatgtggaatttcattatcttgtaatgcatcagcgtgaatttatcgaaggaacctatgatacaggatatgcacagcggtttatcgaggagctgaaacaaaatggagaatttatttaa

SEQ ID NO: 2267 - DNA, 1506 bp, Unknown
  Description of Unknown: Erysipelotrichaceae sequence
ggggtagcgcaaaaggttgcctatcatctgcgcagtgaaatggcgtcaaaagtcaatcgtctgccattctcttattttgaccgtcagtcacatggagaagtcctttcccgtttctccaatgatgtggacatgatccagcagacaatgaatcagtcactgtcacagctgttaagcagttttgtacaggtcgttggttatctcgtcatgatgctgagcatttctctgccgatgacgctgctcgccctgatcgttgttcctttgtccctgctgctgatcacaacagtcgttaagcattcacagcgctattttgccgcacagcagcgttcgctgggaaatgtcaacggacatattgaagaaatgtacagtgcccatatcatcatgaaggccttcaacggagaagaggagagcatcgagacctttgaccgtctgaatgaagagctgtatgattccgcatggaaatcacagtttctcagcggcctgatgaacccgatcagtgcttttgtcggaaacctcggctatgtaggtgtagcgatcctgggtggttatctggctatgaacggatcgatcatggttggagatatccagtcatttatcacatatgtgcgcagcttcaatcagccaatcagcatgattgctcagaatatgaacattctgcagtcaactgccgcagcagcagagcgtgtctttgaattcttgggagaagaagaggagatcgcggaatgtgcagatccggtccagatttttgatgaacagggaaatacaacgctgaaaggtcaggttacctttgaaaatgtccatttcggatatacgccggacaagatcatcattcatgatttttcaatgtatatcaagccggggaaaaagattgccattgtcggtcctacgggtgccggcaagacaacgatcatcaaactgctgatgcgtttttatgagctgaacagcggtgctatttatatcgatggcatcaatacgacagaaatgcaccgtcaggatcttcgttcgctgtttggcatggtattgcaggatgcctggctgtttaacggaacagtcatggaaaaccttcgttatggaaagctggatgccagtgatgaagaagtgatgaaagcggccgatgctgcctatgtggatcatttcatccgtaccttggatcacggttatgatacgatgatcaatgaggaaagcagtaatatttctcaaggacagaaacagctgctgaccattgcccgtgcttttctggctgatccaaagatccttattctggatgaagcaaccagcagtgtggatacccgtacagaggtgttgatccaaaaaggcatggataaactgatggaaaaccgtaccagctttgtcattgcccatcggctgtcgacgattcgtgatgccgatctgattctcgtcatgaaagacggggatatcatcgaagcaggctgtcatgaagagcttatgaaggcgaacggtttctatacgcagctgtataattcacagtttgatgccgaagaagaataa

SEQ ID NO: 2268 - DNA, 1512 bp, Unknown
  Description of Unknown: Erysipelotrichaceae sequence
atgaatgtatcatttatcaaatggatgaaatttaatatcatgcagagcaagcgtttctttttagtttccttgtgcggtttctgcattgtcattccgttgtgtctgttttcgatgcgtacgggattggccgatgtggcgcgggaagtgatcttgctgctgtgtacgacatttacggtcatgatcacgatatatatgtttcgttatctgtatgatcagaaagcggcatcgctgatcctgccggtaccggtgagcagacgtcgtctttacggttatcactggtttggcggatggctgatgatgatgacagtggctctctattatatggccatctactcgatcgaagcgaatatcatttatcctgcttttgtcttctgcattcttttctttcagaatgtcgtttatgccgttaccgcctttttcgtatcccgctgccggcgtacgctggatgccgtgcttgtcggattcggatggcttgttttgacggcgcttttgtatgtcagctttgattctttcgtaaatctgcgctcggtttatttatttaaagcctatgagtattacggaatcacaccggaatctttatattactacatggatatgttcagtctgccgcatctgggactgcggatgactcagatgatgtacccgtattatgaatatagctggaatcagtttctgccttcgatgtggatcgcactgctgtggtggagcatttgtgcggcggcaatgactgcctggtctttctggagggcacctgctctgcggggcgaagaatgcggcgtgaaaaccaattcttatctgatctatcctttgttcatcttgatctgtgttctttcgctgatgaattttctgcagtggaacgaatggctgcctttcttcctcatgatcatttttctggtgtattctgttttgtattttatctacaaacgctgtattcgctttacttcgcatatgctggccggctttgccgttttagctgcctttgagcttgtcttctctgttttgtttgtcaacaccagaggcttcggctttattgaagaagtaaagaccgatcggttccggacgatgaccattacacttccgatcgaagagtatgcgatcaatatcagcaaggaaaatcaggatctgcttaatgaggtcatcaaagaaaaactgatcgacatcgacaaaggcggtgtgctcagtgatatctcgatccacatttcgatcaaggataaagagacgctggccaaaggacagaagatccaaaagaaactgatggaagagtcaaaccagcaaaacggcagtttcacattccgcattacgtatgtatacaacgactatgaatattcacagaccttaaattactatggtgaaaatgaaaaaatgaacgcatgtctggaggatgtactgaatctgatcctggacagagatgcggtttatgatatggattacagcgtgatcacgattgaggaaggcgatatggtcgaatatgactgggaccagaacgcagagggaggagatttgtatgtttga

SEQ ID NO: 2269 - DNA, 1146 bp, Unknown
  Description of Unknown: Erysipelotrichaceae sequence
atgatggatatggaaacaattaacggaatactgttgaaacagatgctagaaagcggaatgaatctgctgtccaataaatctggagaaattgatgctttgaacgtcttcccggtaccggacggcgatacaggtacaaatatgtcacttacattcagtgccggtgttaaagaggcgctgaatgtgcagagcgacagcgtaagtgatatcatgaaggtactttcaaagggactgctgatgggagcacgcggaaactccggtgttattacctcacagatcttcagaggaatttatcaggggatcgagggcctggatgtcatcaatggtgcacagctggcaaaagcgctggtcaacggatccagagtagcctatcgtgccgttatgcgtccggtcgaaggaacgatcctgacggttgtccgtgaagctgctgattatacgtatgcctatgccatggatcaggatgatgtgacatgcgaagaagtcatgagcaagatgctggaggagtcaagagcgtcactggaaagaacgccggaactgcttccggtattggctgaagtcggcgtggtcgacagcggcggcagcggtctgtgtacgatctttgaaggtttcctttccgcaatgtacggagatgtcatcaagccgcaggcgaatgatgcaaaaagcgataaagccggtgcagcgatggagagcgatgaatttggcttctgtacggaattcatcattcgactctctgatgttggggcaagaaactttgatgaaaacagcatgcgcgaagagctggcaacgatcggtaactccattgtctgtgtccgcgatgatgatatcgtaaaagtacatgttcatacgctggagcctgcaaaagcagtgcgcatgggcagaagacatggtacatttgttaaattaaaggcggagaacatgcaggaacagcatgataatctgatagatgatgatgccgtaaatgcggcagtaaaaaatgccgcaccggttcagcaggaacgcaagaaatatgcaatcattacggttgcggccggagacggactgaaagaaatgttccgggaactgcgatgtgattatgtcatcagcggcggacagacgatgaacccgtccacagaggattttgtcgaagcaatcggaaaggtaaatgcggag

SEQ ID NO: 2270 - DNA, 1140 bp, Unknown
  Description of Unknown: Erysipelotrichaceae sequence
atgattattcaaagtaagaaggtctgggtgctcggcaactggctggaggcacagatcgaaatcgaagaaggaaagatcaaagcaattcttccatatgatgcaaaaaaagcggataaagactatggagaaaagcgaatcgttcccggctttatcgacattcatacacatggagcatatggatttgatacaaacgatgcggaagaagaaggtctgcgcaactggatgaagaacatccctcaggaaggtgtaaccggtatcctgccgacaacgatcacacaaagtgaggaagtgctgacaaaggcggttgccaatgttgccaaagtagtagaggaaggatacgagggtgccgaaatcctgggtatccattttgagggaccttatctggatcaggtatacaaaggagcacagcctgaacagtactgtgtaaagggaacgatcgaacagtttgaacgttatcagaaagcggcaaaaggtttgatcaagatcatcacaatggcaacagagcatgatgatgatttcgaactggtacattatcttgccgagcacggtgttatcgtcagcatcggacattcgggagctacattcgaacaggcacagatggccattgccaacggtgcccgcagcatgactcatatctttaacggtatgacaccgttccatcaccgcaacccgggactgatcggagctgctatgcgtttccgtgatacatacggagaagttatttgcgacggaaatcattccaacgtaaactctttgaacaatctgttcctttccaaaggccgtgactatacgatcatgatcaccgatgcgttgatggtaaaaggtcttccgacaggtactaaagtattgttcggcggcaatgaaatcgaactttatccggatggaagtgcacatctgacaagcacaaaaggactggcaggttctacattgaaggtaaatgaaggattgaaagtattagttgaaaaggcacaggttccttgggactatgcaatcaactcctgtacgctgaaccctgcacgtctgctgggaatcgatgaccgtaagggtgcgatccgtgccggatgcgacgcagacatcgttgtcctgaatgatgattattctgttgaaatgacttacgttaaaggaaaagaagcattttaa

SEQ ID NO: 2271 - DNA, 1233 bp, Unknown
  Description of Unknown: Erysipelotrichaceae sequence
atgagaagagcagtatttccgggatcctttgatccggtaacgctcggacatctgcatctgattgaacgtgccagccggctttatgatgaagtcatcgtcgtcattggtgcgaattcacagaaaaacgctttgttttctgtggaagaaaggcgtgcgctgttgacagaatgtcttcgatcggctgcaaatgtgcgggtggatgtcgcagagggtctattggtggataaagtaaaagaactgggtgcggatgtcatgctgcggggggttcgtgacgttcaggattttgcgtatgaaaagcagattgcctgggcaaatcatgagcttgatcccggcattgagactgtctgtctgtttgcgcatgaggaatacggtgcgctgtccagcacgatcatccgtgagtttgcaagctatggtaaagatgtatcgaagtatgtgcctgaaaatgtcgccagggccatacgccgcaaatatacgaacagacacggtgacagaaaggaaaacgacagtatccgtttggaaaaacgggagactgccgcgaaggaaaaaatggaaaaaacaatgtatgactggctgaaagagaacaagatccccttcagccgcaaagatctgatcaaggaagcgctgacccatacatcgtatctgaacgagcatcgtgatgtcgttcatgacaacgaacgtctggagtttatgggcgatgcggtcctgcagctgtggacgaccgagaaactgtttcagctggagccgcgcctgagcgaagggaagatgacgacgcttcgttctcagcttgtttgcgaagcggcactggcacattacagccgtcagctgggctggggcgcgtatttgctgctcggtgtcggagaagaacgtaccggcggcagagagcgggactctttgcttgcagatatgttcgaggcaatgctcggtgccttatatctcgatcaggggatgaagcctgtttccatgatcctggaacgtgtgcttacaccggcaatcgatgaaccgaaaaatgaaatcctgattgactataagacgaaactgcaggaagtagttcaggcggattcgagaaaaacactgcgttatgaactgctggatatggaaggaccgaccaatcatcctgaatttgagatggcggtgcttctcgatgatattgttttgggaaaaggtaaggggaactcaaagaaacgtgcggaacagatggctgccaaggcggcatttgacaaaatggcacgttaa

SEQ ID NO: 2272 - DNA, 879 bp, Unknown
  Description of Unknown: Erysipelotrichaceae sequence
atgaagaacaattatgtgatcatgagcgataacatgggtgatcttcctcagtctttctatgaagaacaccagattcccgtcatgtatctaagctatgtaatgaaagatgaagtataccgtgaagggcatatgcagagcaacgaagagttttaccagcagatgcgaaacggtgcgcttcctaccacatcacagctgacaccggcagatgccagagaacattttttaaaacagctggaacaatatgacgccgtgctctgtctttctttttcatccggactgagcgggacttacaacagctgtgccttagcggcagcccagctgcgggaagaaggatacaaaattgaagtcatcgatactttatgcgcttcgcttggtcaggggctattgctgtataaggctattgaactgaaagaaaaaggggcagactttgaagaagtccgtcagtggatcatggacaaccgcctccatatctgtcatgtcgtattggctgacgatcttttccacttaatgcgcggaggccgcatttccaaatcaacggccgtggtcggaagcatgctctcgatcaaaccgctgatccaaatgaatgatgaaggcaaactgatccctaccggaaaaagccacggacgtaaaaaaggcctgcgtgcccttgtcgacctgatggggtcccaaatgggcagccacagagatgaaaatgatatttttatgatcagccacgccgattgtgaagaagacgcaaaaaaactggcggaaatggtaaaggatgcatacggtattgaccgctgcctgattcattatatcgggccggtcatcggatcacataccgggccggatacaattgcgctgtttttccttggagatcagcgtatgagcaaaaaataa

SEQ ID NO: 2273 - DNA, 1857 bp, Unknown
  Description of Unknown: Erysipelotrichaceae sequence
atgtctgtgaaatatcagatcagcaaaggatcgaaagcgtatggtgccactgtcatcttccgcgatattcaatttgaaatacgtaacaatgaaaaaattgcagtggtcggccgcaacggatgcggcaaaacgacactgcttcgtatcatggcggaagaggaatcgctggacagcggaacgattcacagagaaaacggaacgaggatcggctatctggcacagagtgtatttcaaaatgagcaggcgagcgtgaaggctgaactggaatcagccttttcctatgtaaaagagctggaaaaacagctggaaagtgccgctgccttgctggaaaccgatcctgatgagaaaaatctggatctgtatgcaaaagtgcagcagcagtttgaagaagcgggaggttacagctgggagagcgaaatgatgaatgtcgtaacgcgtttcggctttacccaggaggacctgcagcgccgtgtgaatgaattcagcggcggacagcggacccgtctggccttcgtcaagctgctgttgtccaaaccggatatcctgctgctggatgagccgaccaaccatctggacatcgaaacgatcgaatggctggaaggctatatcagccgctatccgaaagcggtcgtcgtcgtttcccatgaccgtacattcctggatcatgtatgtgatgtcgtttatgagatcgagtatgatgtcatgcgccgttacccgggaaattatacgcactatgtggagacgaagaaacaggatctggaaattcagaaaagcgcctatgcccgccagcagaaagaaattgcccgcatggaggaactgatcgaaaaattccgttataagaaaaataaggcggcatttgcgcagtcgaagatcaaatatctcgagcgcatggataagatcgacaatccgacaagcgacgatgcgacgttccgtgccaagtttcataccgcccgccgcggcggtcagcgggtgctggaaacatccgggctgaagatcggttatgatcatgtgctgtgcgaaatcgacctgcaggtcatgcagggacagcgggtggcggtcatcggtcccaacggacatggcaaatcgacctttatgaaaacgttgatgggacaggtcgcgccgctgggcggttctttccttttgggacatcagatcgacgtcggttatttcgatcaggacctggctcagtttgattcttcgaaaacggtcctcgaggaagtctgggatacgtatccggatctggaccgtacttcggtacggaccgctctgggaagctttctgtttacgcaggaggaagtattcaagaccatcgactgtctctccggcggtgaaaaagtgcgtctttcattagtcaagctgatgctggcacagcctaatttcctgatgctggatgagccgacgaatcatctggatctgctgggcaaagaagcactggaggaatcgctggaaaactatgagggaaccatgctgtttgtttcgcatgaccgttacttcattgccaagctggcaacggccattcttgagatcaaggacgggaaagcagtgtactatccgctgacctatgatgaatatctgcatcgaaacgatgcaccgccggcggtggcgaagaaaccggaaacagagccgaagaaaagctataagcgcaactttaattatgcgaaagcagtcaaacagctggaggaacagatcgaggcgaaggagcaggaactggaagatctgcgcgcgcttcgctttgaaccggaatattatcatgattttatgaagatgaatgaactggatgaaaaaatcgacaaggtccatgttgaaatcgatcatctcatggcgacatgggaagaatacagcgaacatctcgaataa

SEQ ID NO: 2274 - DNA, 1683 bp, Unknown
  Description of Unknown: Erysipelotrichaceae sequence
atgaaaaaattgttagcttcaacagcggctcttgcaatggttgcaactacgttagccggctgtggggggaatggcgacattactgctgaatctggaaaaacaaatttaacagtagctgtcggcggtgactttgcattgcctgatccggcaatcgttgatgattccattactgcaaacgtattggcacagtgctatgatggtctgtacaaactggataaggacggtaacgttgtcgcaaacctggcaactgatctgccggaaattagtgaagacggtacagtttacacaatcaagatcaaagacggactgacttggagcgatggtactccattgacagctgaggactttgtatggtcttggatgcgtgccatgacaacacagggttactacacaaacttcatgtataactacatcgctggtacaactcatatggttgaaaaagacggaaaacaggttgaaatgccatacacagacatggctgacctggaaaagaacatgggtgtaaaagcagttgatgacactacaattcagatcacactgaagatgtcagcaccttactttacttcaatgctgacaaatacagtattctatccggtaaataaaaacgaagtaggttctgatgtaagtaaatctgaatgggtaaaaaatgcttctgcagatgatccgatcgttacaaacggtgcattcgaaattactggcgtaaacatcaaggatgctattactctggcaaagagcgataactatgctgacaaagataatgttaaactcgaaaatatcgaatttaaagtaatgtctgaccttgattctcagacacaggcattcatttccggtgaagtagacttcgctacagcagtcaatgttgaacaggtaaacaacgatgagcagctgcagggacatgtttacaagatcgatccgtttgtatgtaactactacgtactggttaatgccggaaaagaaaataaagaaactacagacggtctgaaagccttgaaagatcctgaaatccgtaaagcaatctctatggctatcggccgtgatgcagcacgtaacgcttatggttacggtgatgactattcttatgacctgtatgcattgatcccaagcggtatccctgatgcagaaggtaacgatttctatgaaacaggcggcaaactgatcactgatgatgtaaaagcagctaaagaaatcatggaatcaaaaggctacagtgctgataacatgctgaagatcgaatacaaatacaacaacctggcaactcataaagctgttgcagaagctatgcagaactcattgaaagaaatctatgttgatctgcagctgaacggttatgaaaaagaagcattcttcggtgaccgtgatgcaggtaacttcgaactggctcgtcatgccatgactgctgactacctggatccaatgtgctatctgtctatgtatgtaggtgcttctacatccggtaatacagttgatgacgcaacattcgaacagatggtcaatgaagctaaccagctgtcaggacaggagcgtatggataaaatgcatgaagcagaaaaatatcttgttgaacagggttatgtaattcctctgttcggatatactgaaccattcctgaaagttaagaacctgactggcattacttcatctccagaaggtcactatgacctgactcacgcttactttgagtaa

SEQ ID NO: 2275 - DNA, 1983 bp, Unknown
  Description of Unknown: Erysipelotrichaceae sequence
atgggtaagatcaatgtgctgagtgagcacttaagtaatatgattgcggccggtgaggtggtagaacgacctagcggcatcgttaaagagttagtcgaaaacagcattgatgccaatgccagaagcattacggtccatatcgtacagggaggcatcgaaagcattacgatcattgatgacggcgagggaatggatgcacaggattccacaacggcttttgaacgtcatgcgaccagcaagatgaaagatgaaaatgatttgtggaatatccatacgatgggatttcggggagaggcgctgccttcgattgcctccgtatcgcatgtctgtctgcagaccaataacggaaaggaatctacagcggttgaaatcagctacggtaagtttttgggggctcatccgcaggcctgtccgttaggaacaagcattgaggtcaggcatttgtttcagaagaccccggcacgctttaagcatctgaaatcaccgcagtacgaattttcgcttatttccgatgtcatcagcaaattttcgctggcttatccggagatccgctttacgctgacgcatgacggcagaacggttttccagacaaaaggaagcggaagtctaagagaaatcctgctgcagatgtatgatcgcaatattgccaaaagtgccattgaaatcaacgggaaagatctggattatgagataaacgggcttgcggtccagccaaagtataaccgcgcaacgaaatactttatctttttattcatcaaccgaaggatgatccgaaattatcatctgcaaaaggccgttttggatgcataccatccatatcttcccaaagaccgttttccgatcatcgttttgaatattgccatggatgcccagctggtcgatgtcaatgtacatcccagcaagtgggagattcgtctttctaaggaaagacagctggaaaaactgatttacgagacgttgaaagaggcattgaagcagaagcatgaatttgttgccttggagagcagaaaagaaaaaccgaaagtggaagtacagacactgaatcttgatcaggatacagaccgtgcactggcaaaactgaagcgggaagtaaacgaaagttttgttgttgaagcaaaatcggagacaaaatatgaacaggtgcctgtctccagttttgtggctgaatcgactcccgtcagatctgttcacaagccgcttgacaacaaagaaaaacaagagcagaccatcgtggcaaagccaatgccaaaaaaaccggaatctgtcgctgtgccgccgaaagaaatgcaggaacagccggcaatcagccataaggaaccggcaacagaaaaagcgcaacagaaggaggatacaaacattccttctgaagaaaaggaacatcgttcagcgccgatacagaaacagcgtcttccgcagctgaggatcatcggtcagtttcataagtcttatatccttgcggaaggtgaaaaggggctttacatcattgaccagcatgcagcgcaggagcgttatcattttgaacagatccgcaatgccattctttccggaaataccgatacacagcagctgctgctgccgctgcagatcgaaacaagcatgtctgccgtacagcggatcgacgagctgaatgaagtacttcagcatttaggtattcatttcgaatccttcggggaaaatacgctgctgtgccgcagccttccggtatggatgaaacaagtggatgaagcggcctttttacgcgacatgatcgacatatggcaaagagaccgacatattaacctggcatctctgcgcgaacatgccatcgcaaccatggcatgtcacagttcgatacggtttaaccgttcgttaacgacggaagaaatgcagcaggtaattgaagatttaaatcagtgtgagcagccgtttcattgtccgcatggccgaccgaccattgtatgtatgaatgatgaacagctgcgaaaggagtttgaacgtggctga

SEQ ID NO: 2276 - DNA, 1209 bp, Desulfovibrio piger
atgaagaacatgttcctgagcaggaaggaaaagaaaaaggaagaagccgctccccagggcggaggcatctcgcgtgctctgggcaaggtgagttttgagggtttcgactggtggctgttcactctgatgctcatcatcctggccatcggcctcatcatggtgctgtcggccagcggcatcgtggccgagcaggtcaacggtgacaaatactactttttcaagcgccagctgatctttgcctgcggcgggggcctcgtgctctggggcgcggccctcatgccccgcagctggctctacaaattgcagtatccggccatcttcctctccctgttcctgctcctgctgaccctgtcgcccctgacgccgtccatcaacggcgccaagcgctggatccctctggggcccgtgaacctgcagcccatggagttcgtcaagatctccctggccctgtacctggcctatttcatgagttccaagcaggcgctggtcaagaccttcagccggggcgtcatcccgccctttgccgtgacgggcctgttctgcggcctgctgctgttgcagcccgacttcggcagcgccgtggtggtggccagcatcttgttcttcatgtgtctggccgggggcacgcgtttcatctatttgttcttcgccatgatcctggcctgcgccggcgccatggccctggccatcctcgagccttaccgcctgcgccgcctgctggcctttctggatccgttcgccgatcccaccgacacgggctatcacctggtgcagtccctgctggccatcggctcgggcggctttttcggcgtgggcgtgggcgccagccgacagaagatgttctatctgcccgaagcccacaacgacttcatcatggccgtgctggccgaggagctgggctttgtgggcatcaccgtggtcatgctgctgttcggcctgctgttctggcgctgttaccgcatcatcatgcgccagaccgaactgcgcgaccggctgacggcctttggcctgacggtcatcctggccatgggtgccgtcatgaatctggccgtggtcatgggggtggcgccgcccaagggcgtgcccatgcccctgatgagctacggcggcagtaatcttatggccaccatgctctgcgtgggcctgctcatgaatttttctcgcacggccacgggcaaggaggggagcatatggaaagagtcctcttaa

SEQ ID NO: 2277 - DNA, 1311 bp, Desulfovibrio piger
atgagctataccaaggaagatgtctggaaatatcatgcggagccccgccccggtaaggtggaagtgctgccctccaagcggggcgagacccaggacgacctgaccctggcctattcgcccggcgtggccgatgcctgccgcgccatcgaggccgatcccgccgccgcggccagcctcaccgcccgcagcaatctggtggccgtggtcagcaacggtacggccgtgctgggcctgggcaacatcggccccctggcgggcaagcccgtcatggaaggcaagggcatgctcttcaagatgttcgccgacgtggacgtcttcgacctggagctggccaccaccgatcccgacgagctcatcaacgtggtcaagaccctggagcccaccttcggcggcatcaacctggaagacatcaaggctcccgaatgcttctacatcgaacagaagctcaaggagatcatgaacatccccgtcttccatgacgaccagcacggcaccgccgtcatctccggcgcgggcctcatcaacgcggcccacatcgccggccgcaagatggaagacatgaaggtcgtggtggtgggcgccggtgccgccggcatcgcctgcgccaacttctacgtcagcctgggcgtcaagcgcgagaacatctggatgttcgacagcaagggcctgatccacaagggccgccaggacaagctgcatcccaccaaggccgccttcgcgcaggaaaaggacgccaccctggccgaagccatgcagggcgcccatgtgttcctaggcctgtccaagcccggtctggtcacgcaggacatggtgcgcagcatggcctcgcatcccgtgatctttgcctgcgccaaccccgtgcccgagatcacctacgccgaagccaaggccgcccgtgacgacctgctcatgggcaccggccgctccgactgccccaaccagatcaacaacgtgtccggcttccccttcatcttccgcggcgccctggacgtgcaggccacggagatcaacgaagccatgaagctggccgctgccgaggccctggccatgctggcccgcgaagacgtgcccgaagaagtgagcaaggcctacggcggcaaaaagttcagcttcggccccgactacatcatccccagcccgctggatccgcgcatcatcgaatgggtgacgcccgccgtggcccgtgccgccatggaaagcggcgtggcccgcgcccgcatcgaggatctggacgcctaccgcgccggtctgcgcgaacgcgtggcccgcatgcgccgtcgcgccgacgccgcccgtctggccaacgattaa

SEQ ID NO: 2278 - DNA, 1314 bp, Desulfovibrio piger
gagccggcagcctttcagaccaaggaatcccctatgtcccagatccgctccagctataccgacagtatcaatttttatggtggccattctcctctggatctggcccaacagttcggtacgccgctctatgtctataatgagaccgtgctgcgccagcgctgccgcgaactcaaggccctttcctccctgcccggctttggcgtcaactattcggtcaaggccaacaccaaccccgtgctgctgcgcatcatccgcgaagaaggcctggtggtggacgccatgagccccggcgagctgtacatggaccagctggcgggcttcaccgccgacgagatcctctacatctccaacaacatctctgaagacgagctgcgcaatgccgtccggcacggcgtgctgatcagcgtggattccctttcccaggtggagaccctgggccgcgtcaatcccggcggcaaggtcatggtgcgcttcaaccccggtatcggcgccggccatcacgccaaggtcgtcaccgccggcaaggagaccaagttcggcgtctcgccggaactgctggacgacctgttcgccatcctgaaaaaatatgacctgcatctggccggcatcaaccagcacatcggctccctgttcatggaggccgacggctacatcgccgctgccgaggtcctgctgcatctggccgaacgtctgcccgccgacgtgctggaaaaactggaagtcatcgacttcggcggcggtttcggcatcccctaccacaaatacgaagaccagccccgtctggacatggacgacctgggcagccgcctgcacggcctcatcagcggctgggcggaaaagaccggctacaccggccgcttcctggtggagcccggccgctatgtggtggccgaatgcggcgtcctgctggggagcgtcaacgccaccaagaccaacggtgacagacgctatgccggtaccgacctgggtttcaacgtgctggtgcgtcccgccatgtacgactccttccatgatgtggaagtgtaccgtcagggcgcgcaaggcccggataccgagaccgtggaacaaagcgtcgtgggcaacatctgtgaaagcggcgacatcctggccaagaaccgccagctgcccctgctgcatgaaggcgacgtgctgggtgtgctggacgccggggcttacggtttcgtgatgtcctcctcctacaaccagcgttgccgggccgccgagatcctgatccaggccgacggcagcgtgcgtctgatccgccgccgcgagaccctggaagatctggccgcctgttacgagggcctgctgtaa

SEQ ID NO: 2279 - DNA, 1377 bp, Desulfovibrio piger
gagccccgggaggatggaaaagtggagctttacaagctgttggaaacctttaacggatttttgtggtgtccggtcatgctggtgctgctggtaggcacgggcatctatctgaatatagcgctgcgctttttctccttccgcaactgggtacgagcttacaagtgcctgtggcaggggcggtcccatcagtccgaacacggcgagatctcgccgtggaatgccctcatgactgctctggccgcagatatcggtaccggtaacgtggtgggcgtggccctggccatcgccgtgggcggccccggcgccctgttctggatgtgggtcacggccctggtgggcatgatgaccaagttcagcgaagtgctgctttccgtgcacttccgcgaaaagacccccgccggcaactgggtgggcggcgccatgtacttcatcaagaacggcctgggccccaaatgggtctggctgggcacctgctttgccgtgttcggcatctgcgcctgtatcggtacgggcggcatggtgcaggccaaggccatcaccgacaatatctccggcaccttcggcctgcccacgtggctgtgcggcctgatcctggtgggcctgtgcgtggccgtgctgctgggcggcgtgcgccgcatcggcgccgtggcgggcaagatcgtgcccttcatggccatcatgtatgtcttcatgtgcctgctcatcatcggcatgaacatcgaaaaggtcccctccgtgttctggtgggtgatctccgacgccttccagcccacggcggccaccggcggctttgtgggcgccacggtgatgatggccattcgtcagggcatggcccgcggtatcttctccaacgaagccggcctgggtaccgctcccatggcccacgcggcctccacggccgagaccccgctggtgcaggcctccatcggcatgctcgacgtcttcatcgataccatcatcgtctgcagcatgacgggcttcgtgatcctggtgacgggcacctggaccgccggttcctccgccgccagcatgatgacctccatggccttcgaacaggctctgcccggtgtgggccagttcgcggtcaccatctgtctgactttcttcgccttcaccaccatcctcggctggtgtgtgtacggtgaacgctgcgccatctacctgttcggcgaccgggcccagatggtcttccgcctggtgtactgcctggcggtgggcgtgggttccgtcctggccctggatgccgtgtggctcctggccgatacctgcaacgcccttatggcgctgcccaaccttaccggtgtcctgctgctgagccccgtgctgttcaagatcgtacgggacgaggtggcccgggacgaccgtttcgtcgtgtag

SEQ ID NO: 2280 - DNA, 1422 bp, Desulfovibrio piger
atgaagctgaaaagcctgccgcgccagctgggatacatcctgggggcccaatggaccagggacctttcctggaccatcttcaccatcctgctggcacggcgcagccccgagatgctgggccagatcgccgtggccctttcctgcggctatctggtcaagaccgtctcggacgtggggctcaacgactttctgctgtccacgttcgcccgtcgggaagaacgcccccgcaccctgctgggcgaggtgacgggcctcaagacctgcttcatgatgctggccctgatcgtcacctggttcgtgacgggctggctggggtacagcttcgagctgcgcctcatcgtcctgttcatcgctacgggcttcggtctcgacggggtgacggactctttcttcgcgctctgccaggcccgcgggcggcaggacgtggagatgcgcatccgcgtgccttcggccctgctgggcataggctacggcatcgtctgcgtggtggccggagcgcccctgatcttcatcgccctctacaagctcatcgaatccgtcctctgcacgggcttcgccttccgtgctctgggccgcaatcccttcgtggggttcggctacgacaatgtgcgcgacctggccgtgaagatgaagagcggcttcatcttcaccatcatggccgcctgcgccatgttctacaacaagatcaatgtgttcttcctcaagaactacggcggcgacgctgccgtgggcggctacaacgtggcctgggagaccgtggaaggcctgtccgtgctggtctccagcgcgctgctcggcaaggtcatcttccccttgctggcccgctactgggcgcaggacagggccgcgttccgtcagctggcggggcagacggcccgctcgctctgggcggcctccctgccgctgatcttcctgatctgcgtggagagcgaccgcttcctgcccaccatctacggcccgggctacgagatggccgccacggcccagcgcctgctgacgccctgcctggccacggctttcctgcacaatctggcggcctatgccatgataggcatgaggaagcataccctgctgctcttcttctatctgagcggtctggtggtcaacatcgtctgctgcctgaccatcatcgagcccatgccgctggaaggggccgcgctttccctgaccgccaccaaggtctgggtggccatcctcactgtgggctatttccagtgggtggcccgtcccatgagcctggggcagtggctgctgatgctggccgccatcgccgtggccgtgggcctgtggtggtcgctgggcatgatcctggccctgccgcgcgaagtggcggaactggccggcctgttgcccctgctggcgctgttctggtactggcgcccgccgccggcttttgagaaggagcagcgtcaggaggcctga

SEQ ID NO: 2281 - DNA, 873 bp, Desulfovibrio piger
atgcacgagatccccctgcaacgtgtggccgccatccatgacctttccggtttcgggcgagcctcgctgaccgtggtcatccccatccttgccagcatgggcgtccagacctgccccctgcccacggcggtcctgtcttcccagacctccggcgtggaaggcttcacctttcatgacctgaccgccgagatggggcccatgctggatcactggcagcggatgggcctgagcttcgacgccgtctattccggctttctgggcaatccgctccagctggagatagcggcccgctgcatcggccacttcctcaagcccggcggcttcgcgctggtggaccccgtgctgggcgacaacggcaccctggaccccacccagacgccggagatggtggaggccatgcgccagctcatcggccacgcccacgtcatcacgcccaaccttaccgaagcggcctttttgctggacgaaccctaccggccggatatttcgcccgacggcctcaaggagcagctgcgacgcctggcggccatggggccggacagggtggtcatcaccagcgccccggcgacccgtcccggccattgcgcggccgtggcctatgaccgcgagcaggggcgcttctggaagatggagtcgccctacatcccggccttctatcccggcacgggcgataccttctccagcgtgctggtgggggcgttccttcagggggacagcctgcccgtggccctggagcgcgcggtgcgcttcgtgaccctgggcatccgcgtcacctacggctacgacacccgccacagcgacggcgtgctgctggagcgcaccctgcccgcgttgcaggaccgttgcgccatcggggagtacgaggcgttttag

SEQ ID NO: 2282 - DNA, 1170 bp, Desulfovibrio piger
gcggggcaggcgttccttgcccgcaggatgcccggcggaaaaggggccgggcaggccggggaagagccgttcatgcccttggggatgcgctgtgcgggccgggccgtttttgcacgggcggcaggggcctgcgtcctgaacctagcccagcaggcggatttgtcaacgccggacgcggtcgcgggcaggtgcccgttttcctttgccttgcgggcggctgccgtgtacaatgcgcgaaaaaatgcaacgcaggtgactatgagcattcttcaggacaatacttcttccgccgccatggagcggctggattccgtggtcgaccgtctttgccatcccgaatccctggacaaggtctggcattgttcggcccgcggcatggccatgccttccctggacaggctgaacgagatcatggatcgcctgcgggccgccctgttccccggctatttcggggccgcgcgcgtctggcgggaatccatgcgccatcatctggccgccaatctggacagcgtctaccgtctgctggccgagcagatccagcgcggcatctccttctcctgcaagggcgagggcgaaggctgccagaactgtgagcgcaacagccgcgagctggcgctggccttcatggacaagctgccggacatccgccacaagctggccggggatgcccaggcgggctacgagggcgaccccgcggccaccagccccggcgagaccatcttctgctatccctccatgtacaccatggtgcatcaccgcatcgcccatgagctgtacagcctcaaggtgccgctgatcccgcgcatcatctccgagatggcccactcccgtacgggcatcgacatccatcccggggccaccatcggcaacgactttttcatcgaccacggcacgggcgtggtcatcggcgagacctgcatcatcggcaacagctgccgtctttaccagggcgtgaccctgggggcgctctccttccccaagaatgccgacgggaccctgaccaagggcatcccgcgccatcccatcctggaagacaaagtgacggtctacgcgggcgctaccatcctgggccgcgtcaccgtgggccggggcgcggtcatcggcggtaacgtctggatcaccgacgacgtgcccgccggggccaaggtcacgcaggagcgtccgtcatga

SEQ ID NO: 2283 - DNA, 1179 bp, Desulfovibrio piger
atgcagatttccgaacgtgtgcgcaccatgaagccctcgctgaccctcagcgtcaacacccgcgccatggagttgcgggcccagggcatacaagtcaccagcctggccgtgggcgagccggacttccccacccccaagcatatctgtgaggccgccaaggccgccatcgacgccaatttctgccgctacacggccgtgcccggcatccccgagctgcgggccgcggtgggcggttacttcaaaaaattctacggcgaggacatcgcccccgaatgcaccatcgtttccgccggcggcaagcatgccctgtacaacttcatgcaggcctccatcaaccccggtgacgaagtgctgctgcccgccccctactgggtcagctatccctacaccatccagctggccggcggcgtgcccgtcatcgtgcaggcctcgctggaacagggcttcaaggtcacgcccgagatgctggacgccaagtgcaccgacaagaccaaactgctggtgctcaacacgcccagcaaccccactggtgccgtttacaatgccgaagaactggccgccatcctggactgggccgacagccgcgacgtctacgtgctgaccgacgagatctatgaccagctggtcttcgctccggccaagatggccagcgccgtgcaccactttgccaagaatcccgaaaaggtggccatcctcaacggcgtttccaagagctttgccatgaccggctggcgcgtgggctatgtggtggcccatcccgagatcatcaaaaagatgtccagcatgcagggccactgcacgtccaacatctgctccatctcgcaaaaggccgccctggccggccttaccggtcccctggatttcctgggcgagatgcgcaacgccttccagcgtcgccgcgacctggccatggacatcatcaacggctgggactttgcttcctgcccctgcccggacggcgccttctacctgttcgtggatgtgcgcaagtgcttcggcggcacggtcaagaactccaccgagctctgcacctggctgctggacaaggcccgcgtggccgtggtgcccggcgccgccttcggtgacgacaactgcatccgcttctcctacgccgtcagcgacgacaccctgcgcgacgccctgcagcgcatcggcgacgccctgtcccagctgcggtag

SEQ ID NO: 2284 - DNA, 1086 bp, Desulfovibrio piger
atggcgcgaatcctttacggcatccacgggacagggcatggccatgccatgcgcgggctgaccatcgcccgccgtctgggcgcacacgaatttctgttcgtggccaatgacgacgcccccaagatactggagcccgaattccgggtgcaccgcatccccaatctgggcacggtgttccgcaactatcaggtggatgtgggcgctacggtgcgcaaggccatcccgctgctctggcaccgtcagcgctatgtggatgaagtgctgcgccttatcgaccagttcaagcccgacgtctgcatgacggacctggaatatttcgtgccgcgtgcggccgagaaggccgggctgcactgcctgaccctcgaccatcagcacgtcatcacctgctgtcgccacggctggctgccgccgcgcatgtggtgggatcacctgctgcagggcatcacgccccgctacctgttccggcccacggagcagaacctgctggtctccttctatgcgccgccggtgcagccccgctaccacgcccgcgtggtgccccccatcctgcgcgaaagcgtgctgcgcctcaatccccgtgatgacggccatgtggtggtctaccagagcaattccacgcaccgcaagctggtggacttcttgctccaggccacggaccgcccctgctatgtcttcggctatgaccggacggaaggccgcgagggcaacgtcatcttcatgaagaagagcgaagagggcttcctcaagctgctggaaggctgttcctacgtcatccagggcggcggccataccctgatgaccgaggccctgcacctgggcaagcccatcctgagcctgccgctcaaggccatggtggaacagtgtttcaacgccctgtacctcgaacgtctgaactacggcatgcaggccgacatgatgaccctggagcccgccttgctgcgccgcttcgaggaatgcctgcccgagttccgggcctccatcgcgcgcgggcatttctgcggcaacgatctggtcttcggcctggtggataccttcatccgcaccggtaccctgccggtatcgggcacgccgaaggtggtggagtag

SEQ ID NO: 2285 - DNA, 1500 bp, Desulfovibrio piger
gtgcgctgccgttcacggcctgccgccgggctgccggagcaggaagccttcccggccagagcccccttgctgcccatcaaccttttccgtgtcagccgcacgcaaacatctttggaacacctcatgccggaaccggatctcagcgtttctccccgtgccatatggaagctcacctggccgcagatgctcatgatgtatctggtcttcttcatgggcttcatcaatatctgggtggccggacgcatcagtgccgacgtgcaggccgcgctcggcatggtcaaccagtgcggcctgttccttatggtcgtggccatgtccatgtccagtggcgccacggcagcggtcagccagtcactgggggccaaacgcatgcgccgcgcccagcgctatgtgggcaccaccgtcctgggcagcctgctggccggcatcctggtggccctgctgggctggcagctgggcagccccatcctgcgcgtcctccaggtcccggagcgcattctgccggtcaccgccggtttctgggacatcaccatgctggccctgcccgcccagtatgtctacgccgccaccggcgtcatgttccgtgccacccggcaggtcctgccgccgctctgggtggcggccacggtctgcgtcttcgacctgctgggctgtctggggctgggcctgggctggttcggcctgccctgcatgggctatatgggcatcgcctgggccaatgccggtgcccagtgtctgggagccgtggccaactgtttgctgctctgccgtgccggttacctgtgccgccgggccatgcccaccactcgctggctgcgggccggtctgccctacctgctcaaggtggccctgcctgcgggtgcggcccagatcgtctggcagtccggctacctcatgcttttcgtcctggtggcctccctgcctttcgacagcatcaacgccctggcgggcctcaccgccggtctgcgcatcgaggccctgctcttcctgccgggcatggccttcaacatgagcgtctccgtgctggtgggcaactgtctcggcatgggcgagcccgccaaggcaaagcgcgtcgctctgcagatgatcgtcatcgcctcgctgggcatgagcgtcgtggcggccctgctctggcccttccgggccgaactggcggccctgctctcccacgaggcgggcacgcaggcccagatcatcaactatctgacctacaatctgctctccacgcccttttccatcgccagcaccgtcatgggcggcgtcatggtgggcgcgggcgccacacgctacaatctgatggtctacggcggcaccttctggctggtacgtctgccgctgggctggctgctgggccactggctgtggggcacggcctccggcgtgttcctggccatgctggtctcgcagtgtttacaaacggccatcatgttttatgttttgctgtaccgcgactgggcccgctttgccatgcgcgcccggcaccatcacgacaacagataa

SEQ ID NO: 2286 - DNA, 1005 bp, Desulfovibrio piger
atgtttgagatccctctcctgctcattctgatcgtccttgtcgccctggtattcgactttaccaacggcgcgcacgactgcgccaatgccatcgccaccgtggtctccaccaaggtggtgacgccccgctttgccgtgggcatggcggccgccctcaacctggccggggccctgctgggcaccgaggtggccaagaccctcggggcgggcctcgtcctgcccgaagtggtccagggcagccatatcctcgtgctggcggccctgctgggcgccatcttctggaactgcctcacctggtatttcggcatcccctcgtcgtcctcccatgcgctcatcggcggcctggtgggtgctgccctggcccatgccgggcccgatgccctcaattttgccggcatcgtcaacaaggtgctgctgccgctggtgctctcgccgctggcgggctttggggtgggcttcctcatcatgtggctcatctactggatcttcgcgcgggtcatgcgcagcaaggtcaaccgcatcttccgcaagatgcagctggtgtccgcggccttcatggccaccagccacggcctcaatgacgcccagaagaccatgggcatcatcaccctggccctgttcatcttcggcgagatcgacgaagtggccgtgcccctgtgggtcaagctggcctgcgccatggccatggccgccggtacggccatcggcggctggaagatcgtcaagaccatgggccaccgcatcttcaagctggagcccgtgcacggctttgccgccgagacctcggccgctctggtcatctccggggcatccgtgctgggcgctcccgtgagcaccacgcacaccatctcggcctgcatcttcggtgtggggtccaccaagcgcctttccgccgtgcgctggaccgtggccggacagctggtcacggcctgggtactgaccctgcccgctgcggccaccgtgggcttctgttcctactggttgctgcatctgatctggaactaa

SEQ ID NO: 2287 - DNA, 1293 bp, Desulfovibrio piger
atggctaccaagaaaactaccacccggagcaaaagcacgaaggctgccgccaagcctgccgccaagcccgcagccaagaccaagaaggctgccgctgcggctgccccggcagaagccgcggaagtggccgtgcgcggcacggacagccccgtgctgaaggaaagccatgcgcccgtggtcaaggaaagcccggtgccggccgaagccgtgaaggccgaagcccccgccgtggccgaacccgcccaggctcccgccgtggctgaagaaaaacctgcccgtacccgcaagagcaaggccgctgccaagcccgccgaagctcccgcggaagaagcccccaaggctgaagaaaagcccgccgaagctcccgcccccgcggcggaagccaaaccggccgccaagcctgccgtcctcaagccccgtgccgacggcggcatgctgcgcgagatcacgccccgtccccagcaggcgggcaacccctacaagcccatgctggccacggtggtggagaccatccaggagaccggcaacatcaagaccctgcgcgtggtcctggacgatcccgatcagatggccaacttcacctatgagcccggccaggtgggccagctctcggtgttcggcgccggtgaatccaccttcgtcatcaacactccgccttcgcagaaggagtacctgcagttctccgtcatgcaggccggtgaagtgacctccgccatccatcgcctgagccccggcgacaaggtgggcgtgcgcgcccccctgggcaacttcttcccttacaatgactggaaggggaagaacatcttcttcgtgggcggcggtatcggcatggcccccatccgtaccatcatgctgcacgtgctggagcacaaggccgactacggcaaggtgagcctgctgtacggggcccgttcgccgcgcgacatggccttcagctacgagctggacggctggctggccaaccccgacctggattgcacgctctgcatcgacaatccctacgaaggctggccgcacaaggtgggtctgatccccaacgtgctgaccgagctgaaccccagcccggacaactgcgtggccgtgctctgcggcccgccgatcatgatcaagttcaccctgcaggccctggaaaaactgggcttccagcccgagaacatcgtgaccacgctggaaaagcgcatgaagtgcggtatcggcatctgtggccgctgcaacatcggcagccactatgtctgcgtggacggcccggtgttcaccatggcccagctcaaggaactgccgcccgaactgtag

SEQ ID NO: 2288 - DNA, 2592 bp, Desulfovibrio piger
atgttcggtttcattttcaaaaagattttcggcagcaagaacgaccgctacctgcgccgcctgcgccccatcgtggcgcgcatcaacgcgctcgaaccccagatgcaggaactggccgacgaggacttcgcccagcgcatggcggaataccgccagcaggtgcaggccggtgaacgcaccctggacgaccttctgcccgaagtcttcgccctggtccgcgaagcctcccgccgtgtcatgggcatgcgccactatgacgtgcagctggtgggcggcatcgtgctgcaccgcggcaagatcgccgaaatgaagaccggtgaaggcaagaccctggtggccaccctgcccgtggccctcaatgccctttccggcaagggcgtgcatgtggtgaccgtcaacgactacctggccacccgcgacgcccagtggatgggcaagctctacaacttcctgggcctttccgtgggcgtcatcgtcaacggtcttgacgaccaggcccgcaaggaagcctacggcgccgacatcacctacggtaccaacaacgagttcggcttcgactacctgcgcgacaacatgaagttctacgccacgcagctggtgcagcgcggccacaacttcgccatcgtggacgaagtggactccatcctcatcgacgaggcccgtaccccgctcatcatctccggcgcttccgacgaaagcgtgggcatgtaccgcgccatggaccagatcgtgcgccagctggggcccgaagactacaccgtggacgagaaggcccgcaccgccatgctctccgaggaaggcgtggcccactgcgaagccctgctgcatgtggacaacctcttcgacccggccaacatcacccagcagcactgcatcctgcaggccctgaaggcccatcacgtcttcaagcgcgacgtggactacatcgtgcagaacgacaaggtggtcatcgtggacgagttcacgggccgcctcatggacggccgccgctattccgacggtctgcaccaggccctggaagccaaggaaaacgtcaccatcgccgccgaaaaccagaccctggcctccatcaccttccagaactatttccgcatgtatgacaagctggcgggcatgaccggtacggccgataccgaagccgtggaattccaccagatctacaatctggaagtggtctccatcccgcccaacaagcccatgcagcgcaaggactaccccgacctcatctaccgtacccgcaaggaaaagtacgatgccatcatcgaggccatccgcgagctgtacgaaaagggccagcccgtgctggtgggcaccatctccatcgagacctcggaaatgctctcccagcgcctgaaaaagctcaacatcccgcacagcgtgctcaacgccaaacagcacgcccgtgaagccgagatcgtggcccaggccggccagaagggccatgtgaccatcgccaccaacatggccggccgcggtacggacatcgtgctgggcgaaggcgtgctggaactgggcggcctgcacattctgggcaccgaacgccacgagagccgccgtatcgacaaccagctgcgcggccgttccggccgtcagggcgaccccggttcctcccgcttctacctctcgctggaagacgacctcatgcgcctgttcggctccgaccgcatcagcggcctcatggagaagctgggcctcaaggatggtgaagccatcgagaacaccatggtcacccgcgccgtggaaagcgcccagaagcgcgtggaagcccaccacttcgagatccgcaagaccctgctggattacgacaacgtcatgaaccagcagcgcgaggtcatctacaccctgcgccgtgacatgatggtggaagaagatctggaacccgtgctgagcgagttccgcaacgatatcctggacgatgcctacacgccgctggagcaggccgataccgatacggccatcgagctgcgcaaggccctgcaggcccgtctggccgacgtcttcaacctgggccgcgtgctggcggccgatgctcccgtgcccgaccgtgccggctgtgaggaatgcatccatcagatcttccagcagctgcgcgaagaagccggtcccctgtaccaggacatcctgcgctacttcctgctggaagaactggaccgcacctggaaggaacatctgcgcaacatggacgccctgcgtgacggtatcggcctgcgcggttacggccagaaggaccccaagctggaatacaagcgtgaaggcttcgagatgttccagtccatgctcttccagatccgcgaaggcgtgttccgcgccctgacccgcgtgcatgtgcagcccgccgaacccgcccctgtcgaggacgccgtggaagagggcaatgccccggccgaagctccgcagcaggaagcccccaaggccaagcccaccctgagcctgcgccacaaggagaacgacgacctggcctactccggcagccaaaccacggatgccggcaaccagcccgccaaggccaagccccgcgtgggccgcaacgatccctgcccctgcggcagcggcaagaagtataaaaagtgctgcggcatgggcaaagtctag

SEQ ID NO: 2289 - DNA, 1161 bp, Desulfovibrio piger
atgacttgggattgggataaattgcaggaaaaacggcaacggcagcaggggcagcgcccctcccgtccgctcttcggtgatgatgataacgacactcaggacgaacagccccggcgcgcccggcgttcgccttccggcaacgggggcgacggtaacggcttcgacggcaggaatgccctgaaaaagctttccggcatgaagatgccgggcggcatggtgatctggctggtgctgggcctggtgggcctgtggctcttgtcgggcatctatatcgtcaaccctgacgaggagggcgtggtgctgcgcttcggcaagtacgaccgcaccgaaggccccggcccccattacgcgctgcccgctcccatcgagaccgtctacaagccccaggtgacccaggtgctgcgctgcgaggtgggcttccgctccaccgggcaggccaccaccttccgtcagggcgagctgcgcagcgtgcccaaggaagcctccatgctcaccggtgacgagaacatcgtcaacgtccagttcagcgtgcagtacaagatcagcgacgcggtcaagtacctgttcaacatcagcgaccccaccaacctggtgcgtaacgccgccgaggccgccatgcgcgaggtcatcggcaacagcctcatcgactcggccatcaccgacggcaagctgaagatccagagcgacgccacggtgctgctccaggaggtcctggaccgctacgaggccggtatccaggtgctggccgtgcagatgcaggacgtgcatccgccgcaggaagtgagcgatgccttcaaggacgtggccagtgcccgcgaagacaagagccgcatcatcaacgaggcggaggcctaccgcaacgccctgctgccgcaggcccgcggtgaggccgcggccatcctcaacaaggccgaggcctaccgggtggcgcgcctgcagcaggccgaaggcgagtcccgccgtttcgacgcgctgcgccaggaatacgagaaggctcccgacgtgacccgccagcgcctgtattacgaaaccatggaagagatcctggccgcttccaaggacaagaccctgctggacagcggggtctccggcaaggtgctgccgcatatgcctcttccgggtacgcccgctttcggcgtcctgccctcggagaagaaataa

SEQ ID NO: 2290 - DNA, 1173 bp, Desulfovibrio piger
atgcccatcagactgttgcaggacatggagtgcagcggcaagaccgttgtcatccgccaggatctcaacgtgcccatgaaggatggccgcatcaccaacgacaaacgtatccgtgcggccctgcccggcatccgcatggcgctggacaagggcgcgggcgtggtcctgctctcgcatctgggccgtcccaccgaaggcgtggtggaagaaaagttctccctggcgccggtggctgcccacctttccggcctgctgggccgtcccgtgaagctggccgccgacttcgacgccgccaaggccgctcccggtgaagtggtgctgctggagaacatccgcttcttcaagggcgaaaagaagaacgatcccgaactggccgccaaactggccgctctgggcgacatctatgtcatggacgccttcggggccgcccaccgcgcccattcctccaccgaaggggccgtgcgcgccgccaaggtggcctgcgccgggccgctcatggccgccgagctggacgccttcgccaaggtgctggacgctcccgcccgtccgctgatggccatcatcggcggttccaaggtctccaccaagctgggcctgctggacaacctgctgggcaaggtggataccctcatcgtgggcggcggcatcgccaacaccttcctggccgctgccggttacagcgtgggcacctccctgtatgagcccgagctggtggacgatgccaggaaggtcatggccaaggccaaggaactgggcaagaccctgcccctgcccgtggacgtggtcacggccagggaactggcccccggccagaccgccacggtctgcgacgtggacaaggtgcccgctgacgagatgatcctggacgtgggtcccaagaccgtggaactgtacgccggtctgttgcagaaggctgccaccgtggtctggaacggccccgtgggcgcctttgagaccgatcccttcggcgcgggcaccaaggccctggccgaagccctggcggcttcccccgccttcgtggtggtgggcggcggcgactccgtggccgctgtggaaagctacggcctggccgacaagatgggctacatctccaccggcggcggcgcctccctggagctgctggaaggcaaactgctgccctccgtggccgccctgcaggatcgcggcgaataa

SEQ ID NO: 2291 - DNA, 1335 bp, Desulfovibrio piger
atgtcacaatccattgttgatgatatcgacatcacgctgggcaataatgccaagcttaaggtcatcggtgtaggcggtggcggcggcaacgccgtgcagaacatgatcacttccggtctgcagggggtgcagttcatctgcgccaataccgatatgcaggccctgagccgcaacaatgccccggtcaagatccagctgggcgaaaagctcaccaagggcctgggggccggtgccaaccccgccgtgggccgtgaggccgccctggaaagcgtcaatgccatccgggaagccatcggcgatgccgacatggtcttcgtgaccgccggcatgggcggtggtacggggacgggggccgcgcctgtcgtggcccagaccgccaaggagatgggcgctctgaccgtgggtgtcgtcaccaaacctttctcttttgaaggggctcgccgccgtcgctttgccgaagaaggtctggaagagttcaagcagcatgtggactgcctgatcaccattcccaatgaccgtctgctggccttcgctcccaagaagactcccttctctgccatgctgcagaaagccaacgacgtgctcttctatgccgttaagggtatttccgacgtcatcctggccgatggtatgatcaacctcgacttcgccgacgtgcgcaccaccatgtccgaatccggcatggccctgatgggcaccggtgtggccgccggtgagaaccgcgcccgcgaggccgcccagcgcgccatcaacagcccgctgctggaagacgtgtcgctggaaagcgccaaggccgtgctgtacaacattacggcgtccatggacatctccaccgacgagatcgccgagatcggcgacatcatcgccgatgccacgcccgaagataccaacatcatctttggtgtggtctatgacgagaacatcggcgacgaactgcgtctgaccgtcatcgctacgggtatcgatcccagcgccacggtggtgcagcccgtggccgagcccgtgaaaagctccagcgtgaccaaattcctcggctcgcaggctgcccaggctgcccgccccatggaagcgccgcaggctcctgcctatgagcagcctcgtccgcgtcccgtgcgccagcgtggagactggatcccccagaactcctatccgcaggggggatacggtccctattccgcccaggaccagttcgagaaaccgacctatctgcgcaccggcgccacgctgggccagcagcccatgccccggcgccagcacaaccccggtcatgaggacttcacctacagtgaagaagacttcgagattcctacgttcatccgcactcaggccgactag

SEQ ID NO: 2292 - DNA, 1365 bp, Desulfovibrio piger
atgcagcgtacccttatcgtcaatgccctggcctccgaggccccgcagcgccagatcaccgtctgcggctggatccgcacccgccgcgatgccaaggacttcagcttcgtggagatcaacgatggttcctgcctgaccaacatgcagtgcatcgtggatgcgggcaccgccgcccacgaaggcctgggcgatgccaacaccggcgcttccgtggccgtcaccggcgagctggtggcctcccccggcaagggacagaagtgggaagtgcgtgccgagagcatccgcgtgttcggcctggccgatcccgaatccttccccctgcagaagaagcgccactccgacgagttcctgcgcggcatcgcccacctgcgcatgcgcaccaacaagtacggcgcggccttccgcatccgctccgaagcggcgcgcgccgtgcatgactacttccacagccagcatttttcctgggtgcatacgcccatcctcaccggttccgactgcgagggcgcgggcgagatgttccgcgtgaccgccctgcccgccggtgaaaaggatctttccaaggacttcttcggccgtcaggccaacctgaccgtgtccggccagctggaagccgaagccctggccctgggcctgggccgcgtctacaccttcggccccaccttccgcgccgagaactccaacaccccgcgccacgccgccgagttctggatgatcgagcccgagatggcttttgccgaactggaagacatcatggagctgggcgaaggcctgacccgccatgtggtggaccatgccctgacccgctgcgagagcgacctcaaactcttcgacaacttcgtggacaagggcctcatcgaccgcctgaagggcatgctggcccagccctttgcccgcgtgtcctaccgggaagccatccacatcctggaagacagcggcaaggagttcaccttccccgtggccttcggcgtggacctgcagaccgagcacgagcgcttcctggccgaagaacacttccgccgtcccgtcatcgtctatgactatcccaaggagatcaaagccttctacatgcgcggcaatgacgacggcgagaccgtggcggccatggacgtgctggtgccccgcatcggcgagctcatcggcggttcccagcgtgaagagcgcctggacaagctgctggcccgcatcgccgagatgggccagaagcccgaggactactggtggtatctggatctgcgccgcttcggcagcgtgccccacgccggtttcggcatgggcttcgaacgcctgctgatgatgctcaccggcatcaccaacatccgcgacgtcatccccttcccccgcactcccggcagcctggaattctag

SEQ ID NO: 2293 - DNA, 1614 bp, Desulfovibrio piger
atgtgggatttctcgtggatcgccgatccctcggcctgggccgggctgggcaccctgatcgtgctcgaggtcgtgctgggcatcgacaacctcgttttcatctccatcctcacctcgcgcctgcatacgcaggaacagcgccgccgggccttcctcaccggtcttggtctggcgctcgtcacgcgcctggtgctgatttccgccatcgcctggatcgtcagtctgaccgagcccctggtcacgatcttcggcaaagccttctcgtggcgagatttcatcctcatgggcggcggcatctttttgctgctcaaggggaccatggagctgcacgagcgcctggaaggcggcatggccgaatactcctcggcgcccacgcgctcgggcttctggcaggtcatcatccagatcctggtgctggatgccgtgttctccctggattccatcatcacctcggtgggcatggtggaccatatcccggtgatgatgctggccgtcatcgtggccatgctggtcatggtcatggccgccgcgccgctgacaagttttgtggagcgtcaccccacggtcatcatcctgtgtctgggctttttgatgatgatcggcctgagcctgctcatggacggtctgggctaccatatccccaagggctatctctatgcggccatctgcttctcggtgctggtggagatctgcaaccaggtggccctgcgcaaccgccgcaagcgcatcagcatgcgcgacatgcgtgaatccatggccatggcggtgctggggttgctgggcggcggacgtcccggcgaggaagaagcgcggcgcgatgccgcggccctggccagcgagagcgatgcccagcccctgttcgagccggaagagcgcgacatggtggcccgcgtgatccgcctgagcggacgcacggcccgcttcatcatgaccccgcgccaccgggtgcgctggctggacagcgaggccgactatgccacagcctgccgttttgccagcgagagcctctcgccctggctgccggtgctggacccggacagggacgaagtgctgggcgtgatccataccggggatctggcggccgtgacgccccaggggcccgtgacgggcacggagcgtcccggtacggcagcgccgcaggatgacggcagcgggcgtgtctggagcgtgcggcccctgctgcggcccgcgcccacgatcttcgagcatgcctcgctgacggagatgctggaaacttttcgcgaagagcccacgcccctggccttcgtgcgtgacgaatacggcagcgtggtgggctgcatcacgcccacggatctggtgagcgtgctggcaggccagatgggcgacatgcccgccgggcccgaagcctgccgccagcctgacggctcgtggctcatgcccggccgcctgaccgtggatgccgtgacctcctggctgggcatccacctgccgccgcgcagctcctcggccacactggcggggctgttgctggaggccctggggcatatcccgcacgaaggcgagcgggtgcgcatccagggctggcggatgaagatagtgaagatggacggcaaccgcatcgacgaggtgctggtccgccgtctggaacattag

SEQ ID NO: 2294 - DNA, 1281 bp, Desulfovibrio piger
atgactcaccgtttcatcccccggctttctcccgaagagatcgcccgccagcagctggaaggcctgcgcttcaccgtgcgccaggctttcaagtccccccagtatcgcaaacgtctggaagcctgtggcgtcacgcctgacgacatcacctcgctggacgatctgcgccgtctgcccaccgtggacgtggaagacctgcgcgaaggctatcccctgcccctgctctgcgtgcccgaagaggaagtggtgcgcatccatgcttccagcggcaccacgggcaagcgcaagatcctggcctacacggccaatgacgtgaataattttaccttgcagatggcccgttgctacgagatggcgggcctgacccccatggaccgcatgcaggtggccgtgggctatggcctgtggacggccggtgctggcttccagctgggcagcgagcgcttcggcatgctcaccatccccgtgggccccggcaacctggagatgcatctgcagctcctgcgcgacatgggctccacctgtttcggcgccacggcctccatggccctgctgctggccgaagaagtggagcgcgccggtatccgcgacaagctcaagctgcgcaaggtcatctgcggctcggagatccgcagcgaaaagatgcgtctggccatcgagagcaagctggggctggaaagcagctatgacatcgcgggcatgaccgagatgtacggccccggtacggccatcgactgcgacgagcacaacggcctgcactactgggccgacatgttcatcatcgagatcctcgatcccgagaccctgcagcccgtgcccgaaggcgaagtgggcgagatggtggttaccagcctgcgcaaggaggccgtgcccctgctgcgctaccgcacccacgacctttcccgcctgctgcccggcgactgcccctgcggcctcagcatgccccgccatgaccgcatcctcggccgctccgacgacatgatcatctaccgcggcgtcaacatctaccccggccagatcatggacgttatcggcgccttccccgaactgggcggcgaatatcatgtggaactgacccgcgacgaccgctcgctggaccacatgaccctgaccgtggaacgcgcccagggcgccacctccggcggcgatgcccagctggtggccgcgctggaacagcgtctgcacaagtccctgctggcccgcgtggccgtgaagctcgccgaccacgccagcctgccccgtaccttcagcaagtccaagcgcgtcaccgacctgcgctag

SEQ ID NO: 2295 - DNA, 840 bp, Desulfovibrio piger
gtgaagaatgtcctgcgcctgccgctggccctgctggtctgcggcctgatctctgcctgtggtctgatggggggcaacggcagcgccgacctgacgcctgtggcacaggcagcccccgctgccaaagccaatgccttcaacccctggatgaacaagagcctgcccaacacccgtaccctttccgctgaaggcatggccatggtgcaggccatgggcgccgaccgccagagcatcgaggacgaggccgcctaccgcccccactggcgcgaagagatctaccccgtgttcttcggcaacaagacggccccgcacgagatcatcgtgctgctggactttgcctcgcccgacagcgcccgcgtctggcaggccgtgcgcgatgcctcggccaagctttctcccgctgacgccaagatcgccgtttttgccaaaaattcggaaaactacggtaccgacctcatgggcatgggcatctggatcagctatgagcgcaagggccaggccatggactacatgagccacgccctcagcgaatggaaccgcatcaaggccgcccagaagaagcaggggcgcagcgtgcccttcaccaacgagtacgatgccaccgtcaagcccagcgacctgcccatccactacgcctatatgggcaagctgcgtccggccgtgccttccagccaggaactggacgtggcccgctactgctacaatgccggcaacgtgaacatgtaccaggccgtgcagatctcccgctattacggcgtgaagcgcatcccggccgtcatcgccgacggcaaggtgctggcctcgccttcagcctcggacatcgtgtccgccctgcgctag

SEQ ID NO: 2296 - DNA, 1629 bp, Desulfovibrio piger
atgaaatttgccatgaagctggcgtttgccgcctgcctgatgctggtgatgggcctccaggcccaggctgcccaggcaaagtctttcgtgctgctgccttttgaggtgcacgcgccccagaactacagctacctgtccaaggccgtgccttccacgctgatgggtcgtctcagtgccacgggcgctacgggcaccatgggcccccgtgcggccggctccgccgccgaagcccgcaagttcatcggcggtgccgactatgccctgtggggcacggtgagcgtcatgggcaatgactgcaccatcgtcctcaacagcgtggacaagaagggctccacctggaccaatacggcccagggccccatgagcgccctgaacgccacggtgcagcgcctcgcgggcgccttctcctccgaggtgctgggcgtcgccggtgccgccgctgccagccgcggcggccgttcggacatcatccgcaacgagaccggccagacggaatcctacttgaacccccagttccgctatcagggcaactccgccgacggttcccgcatccgcagccagcgcctcaaggacgagatggtggacatggccgtggccgacttcaacggtgacggccgcaacgagatcgctatcctgcacgaccatcgcctggtcatctacaagtggggcaacgacggccgtctgggcaagctgggcgagatcaccatctcccgcagcaacctgaacttctccatgcgtgccatcgacctcaaccgcgacggcgccaaggatctggtggtggccaccttcgaagaagagaacaaccgcccctacacctacttctacggcttccgcggcaacaagttcacggaagtggccaagcgctgctcctacttcgccagcgtcatcaacctgccgccttcctaccagcccacgctggtgggccagggctgggactccatcaagctgttcgcccccggcgtgcacatcatggtcaagcagaacggctcctatgggctgggccagcgcatcaacctgcccagcggggccaacgtcttcaacgtggcctggctccccggcaagaacggtgaccagctggtcatgctgaccgacgacgaacgcctgaagatcttccagggcgccaaccagaccctgatccataccaccatggaacgcttctccggttccgccaccggcatggaacactacaagggcatgccgggcctgggcgtggaccgcaactaccagatgcccagcaagtactttgcccccatgcgcctcatcgtggccgacatcggtcataccggcgaatacaccctgctggtcaacaagcccatctccacggcggcccagatcttcgaccgctaccgctacttcccccagggcgaagtgcacgccctgttctgggatggcgtgggcctgggcctgaagtggaagacccgccgcatccgcggttccgtggcggccgtggacctggccgacttcaacaatgacggcatcctggacctggtggtgggcctgaacacctcgcccgatctgggtgtgggcagccgtcagtgcatcgtcaccgcctatccgctggacgtgtcgcagatgaaccccaacgctcctgccgacctcagcgattttgaagtgacccccaactactaa

SEQ ID NO: 2297 - DNA, 2133 bp, Desulfovibrio piger
atgttcaaattctcatccgataccggagacaagaaacgtcgtccgggccgtaccgcatcgcgtaccgtacgcagcggtggggcccggcgtgtttctgttgcgcccaagaacaggggcctgagctgggtcgacagggtggactggggcaaggcccgcatcgccgctgtcgtggccatcttctgcgtcctgtggctgggcctgtggggccgtgcctggtatctgcagatgatcgagggcccgcgtctggccgacaaggcccgccgccagcatatggccacggagctggtcaccggcaagcgcggcatgatcatggaccgcaacgggcaggtgctggcccgcagcgtggaggcccgttccgtctatgcccggccgcaggagatccaggatttcctgaccatggccaacaccctggggcccatcctcggcatcgaaccgcaaaagctctatgacgagctttccaagaccaagcgccgtttcgtctgggtgcgccgcaaagtggacgattacaccgccgaggccgtgcgcaaggcgggcctgcccggcatcggtctttccaaggaatacgaccgcgtctatcccttcaagcatcttgccgggcagctgctcggcttcgtgggcgtggacgacaaaggcctggaaggcctggaacgctcgctggacgaccgtcttgcgggcacgcccacccgcatggtggtgcagcgcgacgccatgggccgccgcttttacctgcatgaagaaggcaaggacgagctccgcggcgaggacttgatgctgacgctggacgtgcagctgcagttcatcgccgaagaagccgtggcccgtgccgcccgggacttcgatgcccgctggagcggggccctggtggtggatgtgcccagcggcgacatcctggcctgggcgcagtatcccttcttcaatcccaatacctaccggcagtccagccccatgatctaccgcaaccggctggcctccgacgccctggaacccggttccaccttcaagcctttcgtcatggcctcggccctgcaggagcgcaagatcaaccgcaatacggccatcgactgcgagaacggcaagtgggagatcaagaaggtgaccatccgcgacacctcgcggcagggcgtgctgcccgcgcacaaggtgctgcgctattcctccaacatcggcatggccaagatcggtctggagctgggttcgcccacgctctacaagtacctgcgcgccctcggcttcggggagagcacctgcgtgcccgtggccgacagccggggcatcctgcgccagccccgctcctggagcgaggccgacctcatgtccgcctccttcgggcagagcgtgtccgtcacggccctgcagatggcgcagggctacttgaccctgctcaacaatggtgtctacaagccgctgcgcctgctgcgcgagcaggtcaatgtggaacagcgttacgagcgcatcttttcggagcgcgtctgccgtgaggtcatgggcatgatgcgcgacgtggtggaagaaaaggacggtaccggcaagcgggcccgcatcgaaggggtggaagtggccggcaagaccggcaccgcccagaaggccgaccacaaggcgggttcctacggcgccaagcgtctggcctccttcgtgggctttttgcccgccgacaatccccgctatctgatcgtggtgctggtggacgaacccaccaagaaccagtacgggggcgtggtggccgcgcccgtgttccgcgagatcgcctcgcgcgccatcacctacagcggcgccatcgtgcctgatgccaccagtcaggcggaaaaggacgacaagccggacaaggacaagggccgtcagcgcggcctcaagctttcgcgtctggatgtgcccttcctggccaaggaagacgtccagaccagccgtccgccgtccatgcagcagcccggccatctggccaaggcctccagccgggtccccgacgtcaagggcaagacggtgcgcaacgccgtggaactttttgcccgcgccgggatcgtgccggagctcaaggggaccggcacgcgcgtggtcaggcagagcccgccgccgggcacggcctggcccaaggaaggagaaaacgtcacttactttctgtggctctcggagaggtaa

SEQ ID NO: 2298 - DNA, 975 bp, Desulfovibrio piger
atgaacagcaaacgtcttcttcctctgtgtggcctgatctgcgccaccgccatgctgggcgcttgcgtgggtcagggcagcagcaacgctgccaacgaaagcatgtatcttgagcagcgcgtgcaggaacacgataccctgctgcgccagatgcagcctgcccaggccgaagtctggaaccaggtgcaggccatgcgccaggaactgaacaccctcaagggcctggtggacgacctgaagaacgtgggcggtgccgctgccctggctgaacgcgtgcgtgcccatgatgccgccctgcgccaggtggagaccagcatggccctcaacctcaacctgggcgagcccatggccgccggtggcgccgctccggcccatgccgccgcgccccaggccaatgcgcccctgttccagccccagcagaacccctatgccgcgcccgccgctggtgccgctgccggtgcagcagccggtgccgccgccggtctggctaccggcccttacggtgatgccgccgctgctcctgccgccgctccggccgctgcgggcagcacctggggccagcccacgccccagcccgaagccaagcccgctgcgaagaaggacatctcgctggccctgtatgacgccggcctcaatgccttccaggcccgcaagtacgatgaggcccagcgttctttcgccgacttcatgaagaactatcccacgcacagcatggctcccgacgcgcagtactatctggccgagtgctacttccagcgcaaccagttccctgacgccgccctggcctacgacacggtcatcaccaaattctccaagagcaaccgtactccgggcgcttacctgaagcagggcatctgcttcagcaagatgaaccagaaggccgccgccaaggcccgcatgaacgagctcatcaagaagtaccccaactcgcccgaagcggcccgtgccaagaacttcctcaagaccaacaagtaa

SEQ ID NO: 2299 - DNA, 1464 bp, Desulfovibrio piger
atggaaagccgccgcaaggtatccggcgacttgcatgaacgtgtctccggcatatatcctgtgcaggcggccttggcaatgtgccgcgtcaaaggagatgcccatatggaacgtcttgcggaggagatccgacgaagggccggggaggccggcccgcgactgacggccctgcgccgtcacctgcaccgccacccggaaccggcctggggcgaatacctgaccgcttcgctggtggcccgtgccctgcaggatgccggtttccggctcaccctgggggccaatgccctgcggccttcggcccgtccccgccagcccgaggcggctttctgtacggcccagagcggccgggccctcaacgagggcgccgaccccaccctggtggcctgcatggccggcggcctcacgggcttgtggggcgaccttgatctggactcccccggcacccctgaagacgagcgcggcccgctggtggccttccgtttcgacatggacgccaacgccggcatcaccgaagccacggacaaggatcactttcctgcggcgcaaggcttcgcctcctgccatgcgggctgcatgcatgcctgcgggcatgacggtcatgtggccctgggcgtggaactggcccgcttgctgggcggcctgcgggacgaactgtcacgccacctgagcggccgcatccgcctgatcttccagcccgccgaggaagagggcgaaggcgcgcccggcatggtggccgccggggccgtggacggcgtccgggccctgttcggcctgcacctgagcatgcaggccagccgcagcggcgatctggtctgcggtacggacaaattcctggccaccaccaatttcgaagtcttcttcaccggccagagcgcccatgccgggctggccccgcacgaaggccgcaacgccctgctggccgcctgtacggccgtgaccaacctgctggccatcgcccgccacggtcagggcgcctcgcgcatcaacgtgggcgagatgcacgtcaacgagacccccaacatcatcccggccaaggcctggctgcgcggcgagacccgcggcgagaacggggacatcaacggctacatgctggccgaggcccggcgcgtggtggacggcgcggcgcgcatgcacggctgccgcagccgcttcctttgccagagccactgcccgggcgccatgtccagccccgaactggtggatctggtggaacgcacggcccgggacatgggcagcttccgcgaagtgcgccgcaaggccgacttctgggcatcggaagactttggctggttcatgaacaaggtgcaggaagacggcggtctggcggcctatctgcagctgggtgccgacaggcccgacgggcatcacaccagccatttcacctttgacgagagcgtcctgccccggggcctggaactgctggcccggctggccgtggccgcactggcccggcgtccggactga

SEQ ID NO: 2300 - DNA, 1074 bp, Desulfovibrio piger
atggacaagagcccttcctcgccgcgtcctttttccgccccgcgttacgccctgaccctgctggccgtgctgctggcctggacgggcctgtacgtatccatccagccgctggccacctggctgaccttcgacctgctctccctgacgcccggcggggccccgggcctggctctggaattcttcctctatgacagcgccaagatcctgctcctgctggtgctgatggtctattgcatcggctggctgcgggccgggctgcatgtggagcgggtacgcgactatctttccggcaagggccggggcatcggctatctgctgggggccacgttcggcgccatcacgcccttctgttcctgctccagcatcccgctcttcctgggcttcaccatggcccgcatcccgctgggcatcaccatggccttcctcatcacctcgccgctcatcaacgagatcgccgtggtcctgctctggggcctgctgggctggaagttcaccgtggtctatgtggtcgtcggcatggcggccggtatgctgggcggctggctgctggatctgctccgcgccgaacgctggttgcagcccttcctgcgcggcatgctgggggtctccggccaggcggcgcgggatgaacgcaacacccgcctggggctggaagaacggcaccgtttcgcctgggacgagatgaccggcatcttccgccgcgtctggcgctgggtcattatcggcgtgggtctgggggcgctcctgcacggctttgtgccgcaggactggtttgccgcccatctgggccaggggcagtggtggtccgtcccggtggccgtcctggtgggcatccccctgtacagcaatgtcacgggcgtggtgcccatcatggagagcctgctgctcaagggcctgcccgtgggcaccaccctggccttctgcatgagcacggtggccgccagcctgcccgagatgctcatgctcaagcaggtcatgcgctggcagctgctggcccttttcctgggcctgttgctggtcatattcaccctggtgggctggctgttcaacagcctgcagctcacgctgttctaa

SEQ ID NO: 2301 - DNA, 1263 bp, Prevotella disiens
atgttgtataatatcggaatgtatgcggttcaagcaggtgttgccctttatagcttgttcaacgagaaagttagaaccatgcgtaaaggcgaaaaagcagccttcgatgtgctgaaaaagaaggtagacccgcaggcaaaatatatctggtttcacgccgcttccttaggagaatttgagcaaggtcgccctttaatcgagaaaattaagcaggactatccccaatataagatactcttgactttcttttcaccctcgggctatgaagttagaaagcattacgaaggcgcagatattatcacttatctgcccattgacaccgtttctaatgcacaaaagttcttgcgcatcgttcgtcccgtcatggctttcttcataaaatacgagttttggtacaattatttgcacattctgcgccatcgcaacataccatgttacagtgtttcaagcattttccgtcccgaccaaatcttctttaaatggtatggacgaaactatgctcacgtactaaaatgcttctctcgcttctatgttcagaacgttgaaagcaaaaaactcttggaaacaattggtattagcaatgctcttgtggtgggcgacacacgtttcgaccgtgttttgcagataaaagaagccagtaagcatttgcctttggtggaaaaatttataggtaatggtcgtgaaaatagtacgaaaagcgaacaacaaacatgccgtcccgtctttgtagcaggctcttcttggcaacctgatgaagagatttttctccaatatttcaatgaaaataaggagtggaaactcatcattgccccccatgtaattgctgaaagccatttacaacaaatcgagcaactcattaaaaacaagcgcattgtgcgttatacaaaggcaaatgaagcagatatagctactgccgatgtgctaataattgattgttttggtttgctttcgtctatttatcattacggagatgtggcatacgtgggtggcggctttggggttggcattcataatgtattagaagcagccgtttggggcatgcctgttctctttggacctaacaacaaacatttcgcagaagcgcaaggattgttggctgagggaggtggttttgaaattcaagacgctgctacttttgctgaaaaaatgcaacaactcacttctgatacaacccatttaaaggcgagtggagaggctgcttacaattttgtggaaagtctttcaggtgcaaccgataaagttttatcaaccatagaattatga

SEQ ID NO: 2302 - DNA, 1773 bp, Prevotella disiens
atgaaagactttttaaaacatgttttagctacaatcattggtattttcctttttggattgataacaatcgcctttgcgttcatttctatcgtgggaatggtgctatcaacaacagatgataaaacagaagtaaaggacaactcggtgttggtggttaatctttcaggacagctaaccgaacgagtggaagaaaatatattcagccaattacgaggcgaagtacagcaaggaattgggcttgatgattttataaaaggactcaaagaagccaaagatgatgataaaattaaaggcatttacatagaagcaggattgttttcttctaattcttatgcgtcattgcaagaagcccgtaacgctattttagactttaaaaagagcggtaaatgggtggttgcctacggagatagctacacgcaaggggcttattatttagcttctgcggccgataaggtttggttgaatccgcaaggcatgatagattggcacggattagccacccaacgtgtttatttgaaagacatgcttgggaagtttggcataaagatgcaagtttcaaaagtgggagcttacaagagtgcaaccgagacgttcacagaagaaaagatgagcgatagcgatagagcgcagactactgcctacctgacaagtatatggaataacatcacaaaagaggtgagcaatagcagaaaagtttcggtagcaaagttgaacgaatatgctgatagcgtgataaccttcgccgcaccaaccgattacatcaaatataaaatggcagataaactcctttacaccgaccaagtgaagaaagaagtgaagcaactattgggcgaagaagccgatgccgacatcaatcaagtttcgcttgccgacatgaagattgatgatacaaaccttgatgatgaaaaaattgccatatattatgcctacggagatattgttgataaccaaatagcaggacttttcggtaacaatcatgtgatagctggaaagcaagtatgtagcgatttggaggaaatgatgaacgatgacaacatcaaagcagtcgttattcgcatcaattctggtggcggttcagcctacgcatcagagcaaatgtggcatcaaattatggaacttaaaaaagtaaaacctgttgttgtgagcatgggcggatatgccgcatcgggcggatattacatgtctgcaccagccaattggattgttgctgagccaacaaccataacgggttctatcggaatcttcggtatgttccctgattatagcggtttggcaacagaaaaattaggattaaaatttgaccaagtggtaaccaacaagaacgcagcattcggttctaacgttcgaccatttaatcctgaagaaatgagaatgatacaagcctacatcgacagaggctatgccacatttaaaaatcgtgtagcgcaaggcagaaaaatgaccattcagcaagttgaaaaccttgcacaagggcatgtttatacaggcgaagacgctctgaaaattaaattagtcgaccaacttggaggcttagatgtagctgttgcaaaggctgctcaattggcacaaatcgacgattattgcacacaaagttaccccaaaccaacctcatggtttgaacaaatcatggaaatggaaccaactggcaattatcttgacgaacaattgcgtgctggattgggcaatctttacgaaccattctctttcttgagaacattaaaccagcaatctgccattcaagcacgattaccttattacattaatataaactga

SEQ ID NO: 2303 - DNA, 1653 bp, Prevotella disiens
gtggctcacattgtgctgctctattctttagtaatttcgttgggagtctaccttggtaaaatcaagattggtggtatctcccttggtgtaacattcattctttttgtcggtattttagctggacacatcggctttacaggaccaaaagaaacccttactttcttgcaagactttggtcttatcctattcgtctttatgataggtttgcaagtgggaccaggtttctttgaaagtttcggaaaaggtggtcttaaactgaacatgcttgctacagttgcaatattattggacgtagccgtaatgtttggttgctattatcttttcttcgatacttcagaccctaagaacttgccaatgatggtgggtacgatgtatggtgccgtaaccaatactcctggtcttggagcagcaaaagaagcattgacaagcgtgtttggcgcaaacatgaattttgatattgcgtctggttatgcttgtgcttatccattgggtgttattggtatcattggtgctactttggctattcgctttatttgtaaagtagacttagatgctgaaaatgcaatgcttacagacggtgaaaaggaaaatccaaatgcgaaaccacacattatgtacttgcgcatagaaaattcttacatcggcggtcgtacaatggaggaaattacaaaattcttgaatcgtgatatcgttattacacgattaatgcatgaaggtgttgtatcattgccttcaaaggaaacaaacctccatgtgggcgatgaagttctcgtggtatgtgctgaagctgatgcacctgccgttgtagctttcattggtccagaaattgaagtagattggcacgaagaagaccaaccaaagcaaatggtaagccgtcgcattgtggttaccaatagtgcaatgaatggtaaaactttgagcaaacttcagttccgttctgtttatggtgtgaatattactcgcattagtcgtcaaggcatggatctttatgctgctaacaatcaccacttgcatgtaggtgatagaatcatggtagtaggttttgaagaaaacgttgagcgtgttgctaagatgatgggtaactcagagaagcatttgaatgctccaaacattgctactatctttattggtatcgttgtgggtattatttttggtagccttccattggctattccaggaatgccagtacctttgaaactcggtttggctggtgggccattgattattgctatccttttaggtcgtttcggttaccgtatgcaccttgttacttacacaacaacgtcggctaacatgatgttacgcgaaataggtttggcactcttccttgcttcggtaggtgtgaaagcgggtgctggcttctgggaaacagtagttcaaggcgatggattgaaatatgtagcaacaggtttcttgattacaattatcccaattttgcttgttggaacttatgctcgcatgaaatataagtttaactatttcactatcatgggtgcgatagcaggttcttataccgaccctcctgctttggcttacgcaaactctgtttgtaatgctgaggctcctgccttgggctactctacggtttatcctttgagtatgttcctcagaattttggtggcacagttgattgtgcttttctgctgcggataa

SEQ ID NO: 2304 - DNA, 2268 bp, Prevotella disiens
atggaaataatgtatctttgtatcgttgtctttctgctttgcttagccgtcttcgatttgtttgtaggcgtaagtaacgatgcagtaaactttttgcaatcagcagttggagcgcgtgtagctagctataaaactatcgttattatcgcttcagtaggagttattttgggggcagtaatgtcgtctggaatgatggacgtagcccgtcatggcatcatgactccgagtcaatattcttttgaagaggtgataacaatcttccttgcagtaatggttactgacgtaattatccttgatatattcaatacgctgggcatgccgacgagtacaaccgtatctttggtcttcgaacttttgggtggaacatttgtgatagcgtgtataaaactgttgcatgatgacaatgcaacgttcgcagacctgatgaataccgagcaagccttgaaggttattattgctattttcgtatcggtggcgattgcttttgtcttcggtgtcattgtgatgtggctttctcgcatcatttttacctttaatcataagctgcattctcgctactctattgccctgtttgggggcattgcctttacggctttatcctattttatctttatgaaaggattgggaaaaagtccgtatctgcctgataatattcgtgaatttatcgatgtcaatataaaaagtttactattcggaacattcatcgtttccactttggttatggaagtgctttatttgttgcgtgtaaacattttcaaatttgttgttctcatgggtacttttgcgcttgcaatggcctttgctggcaatgatttagtaaactttattggtgtgccattggcaggtttagatacttataaagactttgctaccaacggaaatggtgttgctgcttcgggatttatgatgacttcattaatggaaagtgcctctactacgccaatttggctattgagtgcaggcgttattatgattattgccatggcaacatcgaagaaagcgcagaacgttatcaagacaagtgtcgatttaagtcggcaagatgaaggcgacgaaatgtttggtagttcacgtgcagcacgtgccattgttcgtctatctcaaacaactaatagttcgttgtcggggcttattcctgctcgaatagtcaattggatagattcacgctttaaagaaaaagcccaagatgctcctactgatgtcgctttcgatgtggttcgtgcagcagttaatttagttcttgcttccatgttgataaccattggtactaatttgaagttgcctttatctactacttacgttacgttcatggtggcaatgggttcgagtttagccgatagagcatggggaagagagagcgcagtgttccgtgttacaggtgttttgtcggtcattggtggttggtttattactgctggtgctgcttttctcctctctggtgttgtttgtttaatcatgttttatggtggcattttggcacaaatgggcttcatggcattggttgttttcctattaattgactccaatcgtaagtataaaaagaagatgttggcagaggggagcgactctactttccgcttaatgatgcgtactcgagacccagagttggtttgggatatgttgcaacggcaagtatcacgcacacaatcgtttgtttgccacttttctttagagaagttcaacgtgattgtagatagctttgccgatgagaatttgcgctctttgaagaagagtgcaaaggaattgcaaacggaggcacgtatattgaagaaatttagtaagcaagaaatgatagcgttgaagcattgtcccgttgatacagcgattgaaagaaacacttggttacacgttggagcgaatagcaacaagcaatttatttattgtttgggacgtatgttggaacccatattagagcatattagcaatggtttcaacccacttcctcatgaattattagaagagttccgccctgttcaaggtcaagttaatgagttgatgaaacgttctgaagcattaatgtctactggtcgctacgatacttatcgtgatgtgctgtccgatgctacccaattaaaaagaacgctttcggtgatgcgtaagcgtcatatcgaccgtatgcagcgtgcgcatggtaatgctgatttccaagtgtcggtagtttaccttaatttattgcaagaaacacatcaattcttgagcaatatgcgtcatcaattgcgtgctaccaagaggtttacggtgcagagtaattatcttacaatggggtaa

SEQ ID NO: 2305 - DNA, 1983 bp, Prevotella disiens
atggctaaaatattagattcaaaaatcccagaaggaccaatagctgagaaatggaccaattataaggctcaccagcgtttggttaaccctaaaaataaattgaagctcgatgttattgtcgttggtactggtttggctggtgccagtgcagctgcctcacttggcgaaatgggcttcactgtttacaacttctgtattcaggattcaccacgtcgtgcgcactctattgccgcacaaggtggtatcaatgcagctaaaaattatcaaaacgatggcgactctgtttatcgtttattctacgatacagtaaagggtggcgactatcgcgctcgtgaagcaaacgtttatcgtttggctgaagtatcaaatagcattattgaccaatgcgttgcacaaggtgttcctttcgcacgcgaatatggtggtatgttggcaaaccgctctttcggtggtgcgcaagtatcacgtactttctatgcaaaggggcaaactggtcagcaactcctccttggtgcttactcagcattgagcaagcaagttcatgacggacgtgtaaaactttacacacgttacgaaatggaagacgttgttatcattgacgaccacgcacgcggtatcattgctaagaaccttgtaacaggtaaacttgaacgtttctctgctaatgcagttgtcattgcaactggtggttacggtaacgcatacttcctttctaccaatgctatgggctgtaactgtaccgcagctgttcagtgctaccgtaagggtgcttactttgcaaacccagcatacgttcaaattcacccaacttgtattcctgtacacggcgacaagcagtctaagctcacattgatgtcagaatcattgcgtaacgacggtcgtatttgggttccaaagaacatagaagatgctaaggcattgcaagctggaacaaagaaaggttcagatattccagaagaagaacgcgactactacttggaacgccgctacccagcattcggtaacttggttcctcgtgacgtagcttcacgtgctgctaaggagcgttgcgaccatggtttcggtgtaaacaacacaggtttggctgtattccttgacttctctgaaagtatcaaccgcctcggtattgacgttattcgtcagcgttatggtaacctcttcgatatgtacgaagaaattacagacgtaaatccaggtcagttggcaaaagaaatcaatggcgtaaaatactataacccaatgatgatttacccagctatccactacacaatgggtggtatttgggttgattacgaattgcaaacaactatcaagggactcttcgcaatcggcgaatgtaacttctctgaccacggtgctaaccgtcttggtgcttctgcattgatgcaaggtttggctgatggttatttcgtactcccttataccattcaaaattatctcgctgaccaaagtctttggggtaagatttctaccgaccaccctgaatttgttaaggcagaaaagggcgtacaagacgaaatcgaccgcttgatgaatattcaaggaaagcgcagtgtagactctattcacaaggaatttggtcgcattatgtgggaatatgttggtatgggtcgtacagaagaaggattaaagactggtttggaaaagatgaaagcactacgcaaagagttcgaaaccaacctctttatccctggaagcaaagaaggactcaacgtagaattggataaggctatccaccttcgcgacttcatcatgatgggacaacttgtagcacacgatgcactttcacgtaacgaaagttgtggtggacacttccgtgaagaatatcaaacagaggaaggcgaagcaaagcgtgatgacgaaaattacttctatgtaggttgttgggaatataaaggcgacgataccgttgctcctgaactcatcaaagaaccacttgaatacgaagcaattaaggttcaaacacgtaactacaagaactaa

SEQ ID NO: 2306 - DNA, 1251 bp, Prevotella disiens
atggatattcaagaatatgaaataatggcacctgttggctcgcgcgaaagtcttgcagcagctattcaggcgggtgctggctcaatctattttggcattgggcagcttaatatgcgttcccattcggcgaaccatttcacgatagaggatttaaaagagatagcagaaacctgcaacaaacgtggtattaaaacctatctaactgtgaacacggtgatttacggcgaggatattaacacgatgcacgagataattgatgcggctaaggctgccaatattactgctgccattgtcagcgacgtggctgttatggtttattgtcgtcaggttggcttggaagttcacctttctacgcagctcaatatatccaacatcgaggcattaaaattctacgctcaatttgccgatgtggctgttttggcgcgcgaattaaacatggagcaggtggcagaaatctatcgccagattgaagaacaagacattcgaggtcctcgtggcgaattggtgcgcatcgaaatgttctgccacggtgcattctgcatggccatttcgggcaaatgttacatgagtttacacgattcaaatcgctcggctaatcgtgggcaatgcactcaaatttgtcgtcgttcttacaccgttaccgacaacgaaacaggcaatcagctcgaaatcgataataaatacatcatgagtccgaaggatttaaagaccattcgcttcgtagacagaatgatgaaatcgggtgttcgggtgtttaaaatcgaaggtagagcgcgtggaccagagtatgtttatgaagttatcacttgttataaggaagccattcagagcgttttggacggcactttcaccgaagagaagaaagacaagtgggacgaacgcctttcaaccgtgttcaatcgtggcttttgggacggctattatcaaggacaacgcttaggcgaatggacaaaaaactatggcaacaaggctactgaaaagaaagttttggtgggtaaagtgatgaaatatttttcaaaacttggcgttgctgaaattgcagttgaggcttcggaagtggaaaagaaccaatcgatgctcattacagggcctacaacaggtatcatgaagtttgatgccagcgaaatacgctacgatttaaaccccgtagacaaagccgaaaagggttggcgcgtatctatcccagttcccgataaggtgcgtccgaacgacaaagtttataagcttgtgaaaacaaatattgaacaataa

SEQ ID NO: 2307 - DNA, 996 bp, Prevotella disiens
atggaaaatcaatatagaaaaacgtttgcagacttaatggtgggcaaaaaaatagtctatgttcacggctttatgtcgtctggggctacccatacggctaaaattctgcaagaatatatgcctgaatctacggtgattgcacccgacttgcccattcacccagaagaggcgatgtcgcttttacgacaaattcaagcagacgaacaacccgacttattcattggaacatcaatgggtggcatgtacaccgaaatgctttacggcaccgaccgcatctgtgtaaatccagctttccacatgggaacaaccattagcgaaagtaatatgttgggaaaacaagtttttcaaaatccacgcaaagacggtgtacaagaaattatcgttacaaaggcgttgcaaaaggagtataaggagattaccgaacaatgtttttcgggcattacagaggaggaaaaaagtagggtttacggtctctttggcgatgccgacccgattgttcacaccttcgatttattccatgaacattatccgcaagccattcattttcatggtgaacaccgccttgttgagaaagcaatcttccatttcatcatgcccgttattcggtggattgacgacaaacaagaaggacgtgagcgcaaaactgtactcattgattggtctaccctatcagacaattacggaaaaccaaaatcaagtttgttcaaggcttacgaaatgctgttgaaccactataatgtttactttgtagcccctgccccaaccaacaatccaacagcaatgatagaggtgcaaaaatggataaaagaggtgttcagtgcgcctgcttggaaccatgttttatttgctaatgaacctcaactcttattaggcgattacttgatttctaccaataaaaatgatggttttatggggacaacgctgcaatttggcagcgatgaatttaaaacgtgggaagaactcatcatttattttgaaagattgggaggacaatga

SEQ ID NO: 2308 - DNA, 2130 bp, Prevotella disiens
atgaaacgattttttactttacttttaattgcaatgacagggcaaagtgctttgtgggcaacttcgtttgcaaccgctgcaacgacttttcagcatgatttaaccgaaaaagaattgtcagacacgattaaaaccgacccgaaaaaacaaccgattgaacttaaagagattactattcaagcggcaagggtggtgcaaaaacctgacggacaactcatttttccatcgaaaaagcaatgcgaaaagtcggcaaatggatacaacttgttggcaaaactcgctttgccgcatcttcgtgtggacgaagctatgcacacaattagcgcattgaacaacaaaggggaggtgcaaattcgtttgaatggcatcataatcagtaaaaacgagttgattagtttagaccccaaaatggtgaaaagtattgagtttattgacaatcccagtgtgcgttatggcaatgaagtgggctatgtgctgaacattcgcactctgaaagcagaacgaggaggatctgtcgggatagatttaagcaattcgctcacggcaatcaatggtactaatacgttttatgcgaaactaaatagcaataaatcagaattttcgctttcttattcgtctaattatcaagattttaaaggggacagaacaaaagaaaaagcaacctatttactgaacaacaatacgttttatcagatggaacgaaacgacctttcgagccgtaatcgagcgtttaacaatgacctgcaactaaaatatacgcttgctgattcggcttcgtatgttttccaagcaactttatcaacaggatttaaccaccagctcaatgctgacaaaacctatcataccattacgcccgaagctactttcctctcggaaatacgaaataatgaacgaagttttgcccctacgcttgacctctattattaccatcgattgggaaaaacaagcaatttgacagctaatttagtaggtacgagcatcgaaaccaaaggcgataattatttcaacgaggctacatcttatatgtataaagtagacgggcgcatgcgttcgctctattctgaactcatttacgaacagaaactacgcccattcacggtttctatgggactgaaaggttcgctaaaacacattaaaaaccaatatttaggcaatgtagaatcgttaaacaaaatggattattccacgctttacatgtttacggaagccaaaggaatgtggaagaacttaggttatacggcaggtttaggcgttacaaatgctcgctacaaacaagctattgacaaatataactattggctttttcgtccaaaattcaccttaaactatcgtatttcgcaagcccttacactcagatatagctttgaaattttcgaacatatatcgcgtatggctatgattagtaatacaaaaattcgtgaaaacagtcgtgaatggagcgtgggcaacccgaatgttgagcctaacaaggtggtagaacaaatatttggtatcacttacgttcgcccacgctacacaaatacgtttgatgctttcctgcgtatcaattcaaatccgaatatgtcaaaatacatacgcacctctgacgaccagttttactatatgcaagccaatcagaaacgcatcaccatgtggtctgtttccgattatatcaactttaaaatcattcctgacgtattggaaatagggttaaatggtgctatttaccgattcataaacgagggagatgattataaacacagcttgacaaccttcaactttataaccaatcttcaggcttatttaggacgttttacactaagcgcatacgctgataatggttgggaatttaacgaaggtgaaactaaatcccattctggcagtgccatttacgttggtgggagctatcaagtgggcaatttacagttgtcgctttattggcaaaatccttttataacaattccgaagaacctccacgcccaaattttaaatcgttttgtttcaaaagatataatacatcgtgggagcgactatggtaaccttctgaactttaatctttcatggaaattagagtttggaaagcaaaaaagccacacaaaaaagcgcaaggaacacaaagatacagacacgggtatcatgaaaagaaactaa

SEQ ID NO: 2309 - DNA, 1560 bp, Prevotella disiens
atgttagaccagaatatattagaacaagtaaaaggcatatttgcgtccctaaactcgaatataacccttgatgctacgttccaaaataatgataaaaaggcagaagaactgaaggaatttctcaatgactttgcttctacttctgaaaaattgtctgttcaattcacagaaaagggtaatgctcagttgcaatttagtttactaaaagacaataaagaaacaggtattaccttccgaggcatacccaatggacacgaatttacttcactattattagcagttctcaatactgacggacaagggaaaaacttccctgacgaaatgattcaaagcagaattaaagcattaaagggaaacattaaactaaaaacatacgtttcattgacttgtaccaactgtcctgacgtcgtccaagcactcaacctcatgtcgcttatcaacccaaatatcaaacacgaaatggttgatgggggcatttatcaacaagaaataagcgatttaaacatacaaggcgtaccagcagtttactgtaatgaagaatcattacatatcggtcgtggcgatttgggcatgcttttgcaagaattagaagacagagtaggcagcgaaaccattgaaaacgaggaaccaatagaacgccaatatgacgtaatggttattggaggcggacccgcaggtgtctctgctgctatctattctgctcgcaaaggattgaaagtaggcttaatagcagagcgtattggtggacaagtaaacgacacaacgggcattcaaaatcttatttcggtgccacaaacaaacggaacacaattggctgccgacttaaaaagccacttatccgattacccaatcgacttgtttgagcatcgcaaaatagcaaacgtagaattaaaagacaagctaaaaagtatccatgtaaagggtggagaagttttcaaagcaccagctgtaatcattgcaacaggcgcaaattggcgtagattgaacgttggcgacgaagcgaaatacatcggacatggcattcatttctgccaacactgcgatggtccattctataaaggaaaaaatgttgccgtcattggcggcggaaactcaggacttgaagcagccattgacttagcagggatttgtaaaaacgttaccgttttcgagtttggcgacacccttcgtgccgacacaatattgcaagaaaaagcagcaacaatgccaaatcttacaatcataaagaatgcacaaaccaccaatgtgaagggtgatggcactaaactcacagccttaaccgttaaaaaccgattaacagaggaagaaaaagattatgcctttgacggcgttttcgtacaaattggtcttgcagccaatagcgacccattcaaaaaagacttagaactcacaccaagacaagaaataaaagttgatgaattttgccgcacttcccttccaggcgtatatgccgcaggcgatgtaactaatgttccatacaaacaaatcgtaattgccatgggcgaaggagcaaaagctgcactctcagcattcgacgaccgtttgcgaggcatcatttaa

SEQ ID NO: 2310 - DNA, 2457 bp, Prevotella disiens
atggcaaagaagaaaacagagaaaaagccgaagacatttaccgaggcacttggaatcaattatattatcaacgataagacagggtttgtatttggattaatcttactctgtttggctatttaccttattatttcctttgtaagctattttaatacggggcaagccgaccaaagtttggttatggcgttgcgacctggtgaaatagaaaataccgcaaaggagtttcaaaactattgtgggtcggtaggagccttgctctcttacttcctcatcgcacgttgttttggtattccagccttcatcattccattttttatcatcgtttgtggtgttaaaatgattaaggcttacgagaaagtaaacctttggaaatggttctttggtgctgctttgataatgatttggagcagtatcaccttcgcaaagtttgttacacctatcatgggagaaaatgttttcaaccctggtggcgaccatggtgcattcgtggttgaatacattgaaaacgtaataggtcctcctggacttattgttatcttggtggttacgatgattaccttcctcacttacatcacttcggaaaccattacggtcgttaaaaagatgctcaaccctgtgggataccttcgcgataaagtgaagtttaccattgttcgtcgccatggagataaggaagtggtgaaagaactcgatgacgctgttgatgcaaaagaggtggaagaatttctttctaccgagccacaaatggttgatttcttgcaagataacataccagaaccaattgtaaaacctactgaattagaggttacgccgatagaaaagccgaagaaatcggcaaaaaatgatgctgaaatcggtttggaagtggagcgtcctaaccacgaagagaaagctttgggcaaggttgttgcaagcaaggaagacttatcaacacctattaacccacacgaacctttcacaaaatggaagtaccctaccctcgctttgctcaagcaatatgattctgacagcaacgtaaacttcgttgataaggacgaattagaagcaaataaaaatagaattattaaggttttgagcgactttggtgtacaaatcagaagtattcgtgctacggttggtcctaccattacgctttacgaaattacgcctgcacaaggtgttcgcatctcaaagattaagaatcttgaggacgacatagcccttagccttgccgcaatcggtattcgtatcattgcaccaatgccaggtaaaggaaccattggtattgaagtgccaaatgcaaaaccttctatcgtgtcaatgttctctatcttgaattcacgaaaattccaagaaagtacgatggaattgccaattgctttgggcaaaaccattaccaatgatgtttacatggtagaccttgccaaaattccacacttgcttgttgcgggtgcaacgggtcaaggtaaatccgtaggactgaatgctattatcacctctttattatataagaagcacccgaacgacttgaaaatcgtgttggtagaccctaaaaaggtggaatttagtatctatgctccgattgccaaaccattcatggcagccgtagatgagaacgctgacgaaccaattatcactgatgttcaaaaggttgtgaagacattaaaaggtctttgtgtactcatggataatcgttacgacttgctaaaagctgctggcgcacgcaacatcaaggagtacaacaagaaatatttaagtcatcatctcaaccctgaagagggtcatgagttcatgccttacattgttgtaattattgatgagttcggcgatttaatccttactgcgggcaaagaaatcgaaatgccaatcacacgcattgcccaattggcacgtgccgtaggtattcacatgattattgccacccaacgccctactacttccattattacgggtaacattaaagccaacttccctggtcgcattgcgttccgtgtaggtgctatgatggactctcgcatcatacttgaccgccctggtgcgcagcaattagtgggtcgaggcgatatgctttacctcaatggtggcgaaccaactcgtgtgcaatgtgcttttgttgatacgcctgaggttgatgaaatttctaaatttatagccaatcagccaggtcctcgttctccattggaaattcctgagccgatgacagaagacggtactgttggcggaggcagtttggacgaaaacttagacccattatttgaggaggcagctcgtgccattgtgcttaatcaacaaggttcaacgagtatgatacaacgccgttttgccattggttacaatcgtgctggtcgcttaatggaccaaatggaaaaggctggaattgtgggtgctgcccaaggttcaaagcctcgcgaagtgcttttgagcgacgaaatgagtttagagtcattgctttcaagtttacacggcaaccgtatgtaa

SEQ ID NO: 2311 - DNA, 1464 bp, Prevotella disiens
atgaaacaaactaagattgtatgttctatcagtgattttagatgtgaagtcgattttcttcgctcactgtttttttcaggaatgaatgttgtgcgcatgaatactgcacatgccacggaagaggggataagaaaagtagtaaaaaatacgcgagcagtttcgccacatattgctttgctcatcgatacgaaaggtccagaaattcgtacaacagcggtagctgagcctataaaatataaagctggtgatgtcgtgaaaatatttggtcgcccagatgtggaaactactcgtgaaatggtcaatctttcatataaagatattgcaaaagatataaaaattggcaatcatcttttgtttgatgatggggctttggatatggaagtctttgagagtgaaggtcctatgttattgacaaaggtaaccaatgacggagagttaggggcgcataaaagtgtaaatgttcctggtgctcacattgatttgcctgcattaactgaaaaggataaaaagaatattgagcttgcaatcgaacttgatattgacttcattgcccactcttttgttcgctctgccgcagatgttaaggcggtacaagatattctcgatgcacatcattcggatataaagattatttcaaaaattgaaaaccaagagggtgttgataacattgaagaaattattgatgcttcttatggtattatgattgctcgtggcgatttgggtattgaggttcctattgaaaaaatcccaggtatccaacgcagaattatccgtaaatgtatcgccaaacgcaagcctgtaattgtcgcaacccaaatgttgcatacaatgattaacaacccacgaccaactcgtgctgaggttgccgatattgcaaatgcaatttatagttacacggacgctttgatgttgagtggtgaaactgcaagtggaaaatatcctattgaagcgtgtcgtacaatggcaaaaattgctgaacgtgctgaaaaagatgcgcatagagacggttttattgatattcctttgaactcagagatgggacaacgtgaatttttagcgaagagtgcaattgaagcaactgaacaattgggtgttaagggcattataaccgatggtgatacgggcaaaactgcaagaaatttggcagcattccgtggtcctaaccctgtacttgcaatctgctatcatgaaaaattgcaacgttggttaaacttgagttatggattaatcccgatttatcagcaacagcacaaatcaaagcatgaattatttaccgctgctttgcgcatgttgcgccaacgtggttttataaaatcaaccgataaaatagcttatctttcaggtatgagaggcaaagaaggtggcacttctttcttggaaataaatactgtaagtgcagtttttgcaaatacttacaagttccatttgcgtgatgtggaaaatgaaaatgtagaagaaaaatag

SEQ ID NO: 2312 - DNA, 1512 bp, Prevotella disiens
atggctcaagaacaaatacaaattcaagaacagaaacagcaacaagtgcaacgcctttcacagcaacaaatgttgcaagtgaaactacttgaaatgccattaaccgaattggaagaaagcgtaaacgctgaattggacgacaaccctgctttggaaaaagggcaagacgagggcgaatataacgaaagaaatgagagttcagagcaagaagaatacgatttcgattcgcaaagggaaaacgaagagcgacaagatgcgttagattcagctttggaacatatggtttctgacgatgatttacctacatacagcggacaaatgcagcgtgataatgctgaatatgaagagattgtatatggtgattccacttcgtttattgacaaactaaacgaacaaatttcagaaagaatacttactgaacgagaaaaaactgtattaaaatatcttattggtagtctggacgatgacggattactaagaaaggaattagacgttatagccgatgaacttgcaatctaccaaggaattgacttgaacgaacacgaaattgaacatatattgaaactcttgcaagacttcgacccgcctggaataggagcgcgttcgctacaagaatgcttgattttgcagatagaaagaaaggtgaaagaaggggaatgggatagaaatagcaatctatacaaaatcttatttactatcttcaacaactattttgaagcctttacgaaaaagcattgggacaaaattaaaaatgcactcgaactgtctgatttgcaagtaaaagcattacaaaacgaaataagaaaactaaatccgaagccaggagcatcaatgggggaaacattgggcagaaatgtacaacaaattacgcctgatttcatcattgatacagacgaaaacggaaatgtaagtttcactttgaatcaaggagaactgcccgaattgcgtgtttcgcaaagctttaacgatatgctcgaagcatttaaagaaaacaaagagggcatgaataggcaacaaaaggaagcattgctctacgcaaaaggaaagattgataaggcacaaggatttattgaagctatcaaacaacgaagaaatacactctacgttacgatgaaagcaatcatcgaaatacaacgaaaattcttccaagaaggtaacgaagccgatatgaaacccatgattttaaaggatattgccgaaaaaactgggctcgatatatcgactatttcacgcgtaagcaatataaaatatgcgcaaacaaggtggggaacattccctttacgccacttctttaccgacagttacaccactgatgaaggtgaagaaatgtctacaagaaagataaaaatagtgctgaaagaggtgatagagcaggaggataaaagtaaaccattgagcgatgacacgctcgcaaaggtaatgaaagaaaagggatttcctattgctcgccgcacagtagccaaatatcgagaacaattaaacttccctgttgcacgattaaggaaagaataa

SEQ ID NO: 2313 - DNA, 1170 bp, Prevotella disiens
atgggaaaatataattttgacgaaatcgtaaatcgtcgtggaacgaattgtgtaaaatgggacgaagaaaaggaagacggaatcattccgctttgggttgccgacatggactttcctgctgcacctgctattcgccaagccgtagaaaagcgtgtccagcatggcattttcggctatgcaatggtgggggaaagctattatgacgctatcatcaattggtttcaacgccgccatcattggactattcagcgcaattccattatctataccacaggagtaattccagccatcagtgcgacaatccacgctttggcaatgcctggcgagaaagttttaattcaaacctctgtttacaattgtttcttttcgtgcatacgcaatcaaggaacacaggttttagaaaatccattgaagcgagaaggcaacacatttgtggttgattgggaagattttgaagccaaatgtgctgacgaaaaaactactttattcctcctttgcaaccctcataaccccgcaggacgtgtatggacaaaggaagaattggctcgtatgaacgaaatttgtatgcgccacgatgtaaaagtaattagcgatgaaattcattgtgaactcataatgcccgactatacctttacgccgtttgcaaccgtgaacgaagattgcaagcgtaatagtgtcattttcaattcgccaaccaagaatttcaacattgcagggctgcaaatagccaacattatttgcgccaatagagaatggtatagacgcatcaatcgtgcaatcaatattttcgaagtttgcgatgtcaatccttttggcccgatagccttagaagctgcctataatgacagtgaagattggattgacgaactcatgccttatttggctgaaaactacgccttcctatgcgacacctttgaaaaggaactccccgactatgatgtgatgaaattagaaggcacctatttggtttgggtagacattcgcaaaagcggactttcagccgatgcgcttaccgaaaagttgctccatgagggcaaagtgcaagtaaatagtggcgtgatgtatggcgaaacggacggcgaaggttacattcgcatcaatatagcctgcccaaaagccacactcgaagaaggaataaaacgtattgtgaaaacattgaaagcaatttaa

SEQ ID NO: 2314 - DNA, 1041 bp, Prevotella disiens
tttgtatttaaaagcatttatagtatctttgctttccgaatgggaacgaagaaatggttgaatggcataataaaaatagtgctgcccttgattttgggtggtggcattctttattggatgtatcgtggcttcgatttctcacagataaaatatgtaatgcttcacgagatgaattggacttggatgttgctttccatgccctttggcgttctcgcacaagcctttcgggggtggcgttggaaacaagccttagagccagcaggcgagaaagcccgcaattcagtttgtgtaaattccatttttctctcttatgccgttagtcttgtcattccgcgtgtaggcgaatttgctcgatgtggcgtgttgagcaggtatgatggtgtctctttttcgaaagcattggggacagtggtaaccgaaagagctgttgatacgttgatagtagtgctgattagtgctttagcctttctttcgcagataaaagtttttactaattttttcttcaagacaggcacacgtttagacgatatcttcactttttttaccccaatggggtggcttgtaacaggaatttgtggtatagcagctctgattttaatctattcgctccgccgacatttccctatatataaaaaggtgaaagatactttatcgggtatttggcaaggtgtgatttcgttaaaaggcgtaaagaatattccattgttcatcttttacagtttggcaatatggggaagttactttttgcacttctatcttacgttctattgctttgcagaaacaagttcgttgagcataacttgtgctttggtttgcttcgttgtaggttctgttgcagtcattgttccaacgccaaacggtgcaggtccgtggcattttgcagtgaaaacgatgctcattctttatggagttgtcgatgtgcaagcactctattttgtgctaattgtacatactttgcaaacacttttggttgttttccttggcatttatgcttggattgctttagctttcacacggaaaatagtagccaatattcaataa

SEQ ID NO: 2315 - DNA, 2598 bp, Prevotella disiens
atgaaggaaagtagaacttacacgtttgacgaggcgtttgaagcctctttgcgatattttaatggcgacgagttggccgcacgagtatgggtaaataagtatgcgatgaaggatagttttggcaaaatttatgaaaaatcgccagaagatatgcattggcgcattgccaacgaagtcgctcgcatcgaaaagaaatataaaaatccaatcagtgcgcaagaagtgttcgaccttcttgaccacttccgttatatcatacccgcaggtagtccgatgacaggtatcggaaataatcaccaaatcgcctcattatccaattgttttgttataggtttagacggtgatgccgattcttatggtgctattttgcgcattgacgaagagcaagtacagttgatgaaacgccgtggaggagtagggcatgaccttagtcatatacgtcctaaaggctcgcctgtgaacaattctgctttgacttcaacaggacttgtgccatttatggaacgctattctaatagcacgcgtgaggttgcacaagacgggcgccgtggcgcattgatgctttcggtaagcatcaaacaccccgattcagaggcttttattgatgccaaaatggaagaaggcaaggttacgggtgcaaatgtgtcagtaaaaataaccgatagtttcatggaagcagctgtaaacgataaagaatttgtacaacaatttcctattgattcggctcacccgactttcaaaaaagaaatttcggcaaagaaactttgggataaaatagttcataatgcttggaaaagtgctgaaccaggtattctcttttgggacactattacaagagaaagtttgccagattgctatgccgatttaggtttccgcaccatttctaccaacccttgtggcgaaattcctttgtgtccgtatgatagttgcagattgttgtctatcaatctttattcgtatgtgaagcacccatttacaaaagaagctactttcgactttgatttgtttaagaagcacgttcagttggcgcaacgaatcatggacgatattgtagaccttgaaatggaaaagatagacctcattatggaaaaggtaaaagatgacccacaaaatgatgaggttaaattagctgaataccatctttgggagaaaataaaagataaaagtggaaagggacgtcgtacaggtgtgggcataactgccgaaggagatatgatagcagctatgggattacgctatggaaccgaagaagcaacagcgttttcggtagaagtacataagacattggcactctgtgcttatcgttcatcggtaacaatggcacaagagcgtggcgcattctctatttttgacgccaagcgtgaagctgaaaatccattccttttgcgcattaaagaggctgaacctgcattgtatgatgacatgataaaatacggacgtcgcaacattgcttgtttaaccattgcaccaacaggaacaacatcgctcatgacgcaaaccacatcaggcattgaaccagtctttatgcctgtatatactcgccgtagaaaggtaaatccgaacgacacaggtgtgcatattgattttgtagatgaagtgggtgattcgttcgaagaatacattgtttaccataaaaagttcatcgaatggatgaaggtaaacggtttagataccgaaaagaaatacacgcaagaagaaataaacgaacttgttaaacgttcaccttattataaagcgactgcaaacgatgtagattggttgatgaaagtgaaaatgcaaggtgctattcaaaagtgggttgaccattcaatctcggtaacggtaaatcttcccaacaatgttgatgaggtattggtcaataaactttatgttgaagcatggcgttcaggttgtaaaggttgtaccatttatcgtgatggttctcgttctggtgtaatgatttcagtatcaaagaaagacaaaaaagaagccttagagaacgagcaaactaccgaaaaagacttgacttcagccgaagaaacacacgaacacatttgtatgccgccgcgtgttgttgaaattcgtccacaagtgttagactgtgatgtggtgcgtttccaaaataataaagataaatgggttgcatttgtgggacttttagatggtcagccttatgaaatctttacgggtttgcaagatgacgatgaaggcattgtgttgccaaagagtgttacaaaaggtaaaattattaagcaaaccaatccagacggaacacatcgttacgatttccaatttgaaaataaacgtggctacaaaactactgtggaaggactttcagagaagtttaaccctgaatattggaattatgctaaactgatttcaggcgtattacgttatcgcatgccaatagatcacgtcattcaccttgttagttcattgcaattgaaaagtgaaagcatcaatacctggaaagttggtgtggaacgtgcattgaaaaaatatgtaactgatggaacgaaagcgtcaggacagacatgccctgtatgcggacaagaaacattggtttaccaagaaggctgtttgatttgtacaaattgtggcgcatcacgttgtggataa

SEQ ID NO: 2316 - DNA, 2247 bp, Prevotella disiens
ttgaacaaagcagaacttgctgaaaaaataacaggttttttccaaacacaaccagaccaaacttttagtttcaaacagatatttcgtgcattgaaactcactactcacccgcttaaaatgctcgctatcgatgtaatggaagagatggcttgggacgatttcttagcgaaagtaggcgaaaatgcttatacgctgaacacgaaagggcaagtgcaagaaggtgtatttgttagaaaatcaaatggaaaaaactctttcctacctgatgatggaggtacacctgtctttgtttcagagcgaaattcaatgtcagcccttagtggcgaccgtgtaaaagtacagttttttgcacgccgaaccaaccatattaaggaggcaatggtcatcgaaattttgcaaagaaagaaagaaacatttgttggaaaactacaagtggaacccgaaattgctttccttatcacaccagaaaaccttttcgtacacgatattttaatcccaaagaaggctttaaatggtggtaaaacgggcgacagagcggtggtaaaaatcactaaatggcctgatgctgaccataaaaaccttgtcggtgaagtggtagatgtattgggtacagcaggcgataacgatgtagaaatgaacgctatccttgcccaatttggtttgccttataagtatccgaagaaagttgaagaggctgctgagaaaattagtgctgagattacggcacaagacttggctgaacgtgaagatttccgtgatgtttggacttgcaccattgacccaaaagatgcaaaagactttgacgatgcgctctctattcgtaagcttgaaagtggtttatgggaggttggcgtacacattgcagatgtatctcactatgtaaaagagggcgatattattgacaaagaagcccaaaaacgtgctacatctatctaccttgtagaccgaacgataccgatgttgcccgaacgtctttgcaatttcatctgctcattgcgacctaatgaagagaaattagcttatagtgctatcttccatttagacgaaaatgcagaaataaagcacttccatttggcgcacaccgtcattaaaagcgaccgccgttatgcctatgaagaggctcaaaagctattggaagacaatggcgtagtagacggaacgggcgagccagcacctgctcctgacaaagaaggctataagggtgagtttgccgaaaacatcattacactcgaccgtttagcaaaacttttgcgcaaagaccgcttcaaaaatggtagcgtaaactttgattcagaagaacttcacttcgatattgacgaaaaaggcaaacctattcgctgttatttcaagcgttctaaagatgccaacaaactgattgaagagttcatgctccttgctaataagtatgtagccatgcaagttggaaaggtagcacggggcaaaaaagccaaaaccctaccctatcgtgttcacgataaccctgacccacagaagtttgagaacctccgtcagttcactgccaagtttggttaccgcctcaaatcatcaagtacgaagggcgcaacggctcgtgctttgaacgcattaatggctgaagtagaaggcaaaaaggagcaaaaaatgattcaaaccattgctttacgttccatgatgaaggcaaaatacaccacgcataacattggacacttcggtttggcattcgactattacacgcattttacatcgcctattcgccgctatcctgacactatggtgcatcgtttgcttaccaaatatcaagaaggcggacgctctgccaatcaagaccatattgaagagttgtgcgaacactgctccgacatggaacaagtggctcaaaatgccgagcgcgactctataaaatacaaaatggtagagttcatgggcgaccacttaggcgaatgtttcgacgctcatatcagtggtattcagagttttggaatctatgccgaaatagacgaaaaccactgcgaaggcatgattcctatgcgtgatttggacgatgattactatgaatttgacgaaaagaattattgtcttgtagggcgcagacaccatcatacttaccagttgggcgacccaatacgcataaaagtggcaaaagccaacttggaacgcaaacaacttgacttcacattggctgatgatgacgaaggcaaaaaggcacaaaaaacgctgcaaaagcctaagtctaacggtcattcaaaaggacataaaagatgtagataa

SEQ ID NO: 2317 - DNA, 1065 bp, Prevotella disiens
atgaaagaaaagtgggaagataattttcaaaaagtttttagcgactacgaacgcaaggtgcctgatggtttgttggacgatataaagcgtgaaatagagaaaaggaaacttgttccgaatgctaaaaaatcgtctgcaacactcattccattatgggctcagcaggttgcagctgctgttgctgttgttctcattgtcatgggaggattcttatggggaagaaagcaagctgccggaacagagtttgctgctttaacccctactgcgtctatggctacaagcacattgcctcaaaaaggaaattcaaattttatgaccaatgcttggaagtctgtaaaatcaatggtcaatggtgttcatgtgaatggtggaactttttcaaccaacttgtttgctgctgcttccaatccatttctttcagaaagaggtaataatggtgcgacaataacaaatgtcggtctgccatcaacagagtctattgaaaacatagccgatttacaccgagttacgcttggcactatgccacaacaagataactacaaactcaaacaaagtgatactcaaatccaaaataatagagtcgacaaagcaaatcgttttgaacgttctgctcagttagcggctgtttgtgctggcaatttgcaaagcaatgaactttgttatacaaatgtgccgttatatagcatgcgaaacaacgattttgaaatggcagataatatgaattattatcaatctatgaatttgggcttgtcagtacgatataatgttaccagcagatggagtttcttgacagggctgacctatgcaaaaatgcgttccgcaacaactatgaatgatagaaatgtaggtttccatgaacaggatttacgaactgttgtaaatgcaaaagaaatccaaccacaattgtctgggaaagatgaatataatttcaccaaacaagtgggcatttattcacaacatggtatcggtaattatgttaatggtggcaatgtggacaatttttacaagagcaaaccatttaacgttcatcttaatttgggacaaagactaaacggaaataaataa

SEQ ID NO: 2318 - DNA, 3357 bp, Prevotella disiens
atgaattttacaaaattaatgagatcgctcttcggcgataaatcaacacgcgacatgaaactcattcagccgtttgttaataaagtaaaggaagtatatccacaaatcaaagaattaagcaacgacgatttacgtgctaaaacaaaggaaattcaacaatttgttcaagatgcaggtaagcaacaacgtgaagaaatagcaaaactccgtgagcaaattgaagcaacacctatcgacgaacgtgaagaaatattcaataagatagataaaattgagaaagaagcgttagaaaactacgagaatgctttgaacgaagtaatgccagtagctttctcaatcgtaaaagatactgctcgtcgctttactgaaaacgaagaaacaatcgttactgctaccgacttcgaccgcgagttggcagccgacccaaataaagatttcgttaccattgaaggtgataaggcttattatcacaaccattggacagctggtggcaacgaccttaaatgggaaatggtacactatgatgtgcaacttttcggtggtaccgtacttcaccaaggtaaaattgcagaaatggcaacgggtgaaggtaaaactctcgtggctaccttgcctgtattccttaacgctttgactggcaatggtgtacacgttgttacagtgaacgactatcttgctaaacgtgactctgaatggatgggacctctttacgagtttaatggtctttcagttgattgcattgacaagcaccaacctaattctcctgaacgtcgtaaagcttaccaagctgacattactttcggtacaaataacgaatttggtttcgactacttgcgtgacaatatggcagtttcacctgctgaccttgtacaacgtcagcacaattatgcgattgtcgatgaggtggactcagttctggtcgatgatgctcgtacacctcttattattagtggacctgttccaaagggcgacgaccaaatgtttgaagaatatcaaccattggtacaaaaactctttgaggttcaacgcaaacaagctaccgaacttcttgccgaagctcgtacaaagatagcacaagcgctcaacataaaggacgacaaagagcgttcaacgatgcttgaagaaggtttccttgccctttatcgttcacacaaagcacttccaaagaacaaggcgctcattaagttcctttctgaagaaggcatcaagtcgggcatgttgagaaccgaagaatattacatggctaacaacaaccgtgaaatgccaaaggctgtagaaccgctttattttgtaacagacgagaagttgaactcatgcgaccttaccgataagggtggagcatggcttgcaaaagaagttagcgatgatactttgttcgttcttcctgatattacaaccgagttatcagcacttgaaaaggaaaaagaagaaaagaaaattgatgagcaagcttatatcgataagaaagacgaaatgatgagcaactatggtgtacaaagcgaacgtgtacatactttgcaacaattgctcaaggcttataccatgtttaataaagacgatgagtatgttgtgcttgacggtgaagtaaaaatcgttgacgaacaaacgggtcgtatcatggaaggacgccgttggagcgatggtttacaccaagctgtagaagcaaaagaacatgtaaaagtggaagctgctacacaaacttttgctaccattacccttcaaaactacttccgtatgtaccacaagttgtcaggtatgacgggtacggcttcaactgaagcaggtgaattttgggatatctacaaacttgatgttgttgaaattcctaccaaccgtcctatccaacgcaaggatatggaagaccgtgtctacaagaccgctcgtgaaaagtatgctgccgttatcgaagaaatcgaagaaatgcgcaatagtggtcgtccttgtttggtgggtactacctctgtggaaatcagtgaattgctgagtaagatgctcaatatgcgcaaaattccacaccaagtattgaacgctaagcaacacttaaaggaagcacaaatcgttgcagaagctggtcagtcaatcaatggactcggtgcagttaccattgctaccaacatggcaggtcgtggtactgacatcaagctttctaaagaagtaaaagaagctggtggtttagcaattatcggtaccgaacgccacgaaagtcgtcgtgtagaccgacagttgcgtggtcgtgcaggacgtcaaggcgacccaggttcttctgtgttctacgtttctttggaagacaaattgatgcgtcttttcggttcagagcgtattgcaaaggtgatggacaaactcggtttcgaggaaggcgaacgcatcgaaagttcaatgatttcaaatagtattgaacgcgctcagaagaaggttgaagaaaataactttggtattcgtaaacgtttgctcgaatacgatgacgtgatgaacaagcaacgtaccgtaatttacgaaaaacgccgccacgctctcatgggtgaacgtatcggtatggatatttcaaacatcatttgggaccgttgcttgaatattattgaatcaaacgattatgaaggttgcgtagaagaattcctcaaagttttggctatggaatgcccatttaccgaagctgaattagcaagtgcaaataaagaagagttggcagaacgtagttttcaagctgcaatccaaaactttgaacgtaagaccgaacgcattcaaaccgtagcatggcctatcattaaagaagtttacgaaaatcaaggtgcgatgtatgaacgcatcatggtgcctattactgatggtaagcgtgtttacaatattccttgcgacttaaaagaagcatacgattcggaagcaaaatcagttgtaaagcagtttgagaaagttattcttctccacctcattgacgatgattggaaagaaaacttacgccaattggacgatttacgccactctgtacaaaatgcgtcatatgaacaaaaagacccattactcatcttcaaacttgaaagtgtgaaactttgggacaacatgattaacgacatgaacaatcgcacagcaagcgtattgatgcgtggtcagattccagaaatgcaaccagctgaagaaatacgagaagctgctccagagcaacatgtacaacgttatgaggaaacaaaagacgacttgattgaccaaaatcagcaagctgccgctcatcacgatacgcgtgaaactgcccaacagcctcaacgcacaccttatatggcagagaagatgccacgtcctaacgacccatgtccatgcggaagtggcaaaaagtttaagaattgccatggtcgcaatatgagataa

SEQ ID NO: 2319 - DNA, 1968 bp, Prevotella disiens
atgttatcaatagaaggtttgaaggttgagtttggtgtaaaaccactctttcaagacgtttctttcgtggtaaacgaccgcgaccgcattgctttggtgggcaagaatggtgctggaaaatctacaatgctgaaaattctttgtggctatcaaaagccaacaggaggcgttgtggctattccaaacgaaactaccattggctatttgccacaggtgatgaagctatcggacgatactacggtgaaggaagaaacccgaaaagcatttgccgatgccacaaaaatgaaagaaaagttggagcaaatgcaacaagaaatggctgaacgaaccgactatgagagcgatagttacacgcaacttgttgaacgttttacgcaagaacatgaacgttttatgatgttagggggtgaaaactacgaggcagaaatagaacgaacattagtgggattaggctttgagcgtacagatttcgaccgtcctacacgcgagttttcaggtggttggcgcatgcgtatagagttggcaaagatacttttacgccgccctgacgtgctattacttgacgaaccaaccaaccatttggatattgaatctattcaatggttagaacaatttctttcacaaagtgctaaagccgttgttttagtatcccacgataaggcatttatcaataatgttaccaatcgaaccttggagataacatgcggtagagtcgaggattacaaagtgaaatacgatgaatatcttgtgttgagaaaggaacgcagagaacaacaactgcgtgcttacgaaaaccaacagaaggaaatagctgatataaaagcctttattgaacgtttccgctatcaagctacaaaggcagtacaggtgcaacaacgtattaaacaattagaaaaaattgtgccaatagaggttgatgaggtagacaattcagcgatgcgcctaaaatttccaccctgtcttcgaagtggcgattaccctgttatctgcgacaatgtacgcaaagaatatcctccacgccttgtgtttgacaatgtcaatatgaccattaagcgaggcgaaaaggtggctttcgtgggcaaaaatggtgaaggaaaatctactttggtgaagtgtatcatgggcgaaatagcctttgacggcaatttaaaagtagggcataacatacaaatcggttattttgcacaaaaccaagcccagttattggacgaagaactaacgattttccaaaccatagacaatgtagctaaaggcgatatgcgtttgagaataaacgaccttttgggtgcttttatgttcggaggagaaacctctgaaaagaaagtgaaagtgctttcaggtggtgaacgttcccgattggcaatgataaaactcttgttagagcctgtcaatctgttgattttggacgaaccaaccaaccaccttgacattacatcaaaggaggttttgaaggaagccattaaggctttcgatggaacagcgattatcgtttcacacgatagagagttccttgacggacttgtaacaaaggtttacgagtttggaggtggtaaagttcgtgaacatttaggtggcatttacgattatttgcaggctcataatgcggcaacaatccaagaaagtttgagcaaagcgagcaacaatgttgccacagaaacgaccgaaaacaatgcgaatgtaaagcaagaaagcggaaaagaacctacctctggcgccttaacctacgccgaacgaaaggaacaacaaaagaaaataaagaaagcgcaaagggctgttgaggagtcggagaagaccattcagaaaatggaagagcgcaaaatggagttagacgagttactaatgtcgcctgaaaacgcttcaaacatggaacttgtaaccgaatatacagacttgcaacgccgcttagacgaagaaaacgagcgttgggtaactctttcggaggcattagaaaacttgcaaatagaataa

SEQ ID NO: 2320 - DNA, 1506 bp, Prevotella disiens
atggaatgtgtatcattcgaacactcagctaataaactcgaggctttattaggcaaagatgccagagagtttaccaaggaagacattgttcaagttgttgataagcttggcattgaaatgttaaacttcatgtatcctgctggagacggaagattgaagactcttaatttcatgttgcattcacgtgagtatttggaaacaattcttaccagtggtgaacgtgtagatggttcttctctctttagctttattgcagcttcaagcagtgacttatatgtcttgccacgttttgcaacagcttttattaatccttttgaggagattcctacactttgtatgctttgttcattctttgacagagatggtaatccattagaatcatcaccagagcatacattgactaaagctatgaaggctttcaatgatgttacaggtatggaatatcatgcaatgggtgaattggaatactatgttatccaaccagacgaggaagtattcccagctgaagaccaacatggttatcacgaaagttcaccatacgctaaggtaaatgacttccgtatgcgttgtatgaagcttattgcgtcttgtggtggtaaaatcaagtatggtcactctgaagttggtaacttcgttgaagatggtaattgctatgagcaaaacgaaatcgaatttttgccagtacctgctaacgaatgtgcagaccaaatcatggttgctaaatggattattcgtagcttgggctatgaagaaggtttcgatataacatttgctcctaagattactgttggaaaagcaggttctggtatgcatatccacatgcgtatgatgaaagacggtcgtaacatgatgttgcacgaaggcaagatttctgatgaagcacgccacatgatagctggtatgatggatttggcaccaagtatcactgcctttggcaacaagaatcctacatcatatttccgtttggttcctcatcaagaggctcctaccaacgtatgttggggtatgagcaaccgctctgtattggtacgtgtaccattgggttggacttcaggcgaagatatgtgccacaaggcaaatcctttgcaaccacatgaagaccgcgattatacattgaagcaaactgttgaaatgcgttcaccagacggttctgcagacatttatcagttattgtcaggactttgtgttgcttgtcgtcatggtttccaaatggaaaatgctttggaagtagccgacgcaacatttgctgatggcgatattcacgattcaaagaatgcagaacgttacgctaaattggctcaattgccagattcatgcgttgcatctgctgattgtcttgagaagcaacgtggtgtttatgaagaattcggtgtgttctcaccagcaatgattgatggtatcatcgctcaacttcgtggcttcaacgataagaatactcgcaaggaagtaactggaaacgatgatgctattgcagaattggtaaagaaatatttccactgcggctaa

SEQ ID NO: 2321 - DNA, 1284 bp, Prevotella disiens
atggatacgaacgaaactttaaacaataaaaaatggctgtggctacccaccgtttattttacgcgtggattgccttacgtcattgtgtttctcgtttcattggtatttttcaatagaatgggcttgtcaaatggtacgataacgctgctcacctcatggtttttcattccctttattctgcgtcctttgttgggtagagttgttactggctatgccacaaaacgcttttggatactcgcaatggagttcttaatggctgcttccatgtttggaatctcaaagctaataactgcttcctattgggaaataggttccatgctactctttattataatagcttgtgctgctgtaatacatgatgttgcggtggtaaggttctataaactgagtatatctcgtaaatcgccaggggtaagcagtgtgcattcggtattcttgctcatggctattgtggtcggaatgggtattcctttaaccttagcaggtaatcttgaaatgctcaatcgtgtcgttgcgaagtcgtgggtatctactttttatttattatccgtaacgtttttattgctttttatttatcatttttgggtgcttcctcgacccaaagacaagccgtctatacctgtacgtagcggattgacccgtcgttggtggttggaaaccaaaactactttcatgcaattgcctaactatgtggcgttgctttcttttcttttgctttatttaatccccgaaggaatgtttttccgcatagctcctttgttcttaatcgaccctggaagcaatggcggattgagtctttcgccacaagaattgggcttggttcaaggttcggtaggtgcgtttgctgctatttttggttgcattttaggtcgtcagtctatcgtaaaaagaggattaatgggtagcctttggttcatggtttgtgctataacattgcccaaaatgctttatatttaccttagctacaactttgtttccacactttctgttatcaatatttgcgtggcagtggaacaatttggttttggttttggcattactgcctatattttgatacttctttattgttcgcaaggtaaatatgccatcttccgttactctattgcgagtgctattgcagccttatctcttatggcatctggttggtttacaggcattcttcaagaatatttaggctatcgtcgcttctttgttattgtggcaatcgttaatattttaccttttatcgtaacggcatttttaagtcgttctacccaatttgaaaaggaaaatgaaataagatag

SEQ ID NO: 2322 - DNA, 4431 bp, Prevotella disiens
ttgaagaagctaagaacttttatacgctggtttgtatggtctgcaataggactgtacttgcttacgatagtgttattgcgcatgtcttttgtgcagcactttgtaggctcacaagttgcaaatgccctctccgaaaagcttggaacaaaggtttcggtagagcgtgtcgatttaggaatgttaaaccattttgtggtagacggagttgttatcaacgaccaaaccgacaaactcatggcgagagccacacgcattgcagcaaaaattgatatttggacactcattaaggaagggaaagtgcgcatcacatcagcgcaagtcttcggaatgaatgcccaactttatcgtgcaacccctacttcaaagcctaattttcaatttgttatcgactccttgacttcacgcgataccacttcgaaaaagccgttagacttgcgcattcaaagtttgattgtgcgccataccaacgtgcgttacgatgttctttcccaacctacgacacatcatcgtctgaatttcaaccatttagacttgcgcaatgtttcgggacacatcaatttaaacgaactgaccgaccaacaaatcaaagctgctatccgcaacttttcgttcaccgaagcatcgggtttagaccttaaaaacttgcgtttaaatcttacagccaatcagaaaagtatagaaatgaaagatgtttttgtggaacttccacaatcgaaaatttctatacctttctatcaagcaactttcaaaaagggtgaaaagaagcctaatctaaaccgtgcaagacacgaattgcgcataaaaaattcgtatattacgccacaagatttggctttcctcctaccccaactccgtccatttgggacaaaattgcatttgaaagcaaacgttgcaggtgatttgcagcagttgaacataaaaaaaattgtattgcgtgccgaagacagaagtattgttgccgatttgcaggggcaattgaaaaatttgcaaaacagcctattttggaacataaaagctattgttttgcaagtcaaaagcggcactattaaaaatgtagcgaaggctttccattttaacctaccgaaggaaatctacaatattggggatataaattttaaaggaaaggtgtcaggtggagggcaaaatcaccatataaaaggaactttaacacttgctgcgggcaatgccgatgttgatgtttcgctcaacggaaaaaaacttcggggcaagctacatacccaacattttgcgttgggaaatattcttacgtcgtcgcacatcaacgcttttgttgccgacttgtttgtcgaaggtactaccgaccttaaccacctgtatgccaagggttctgttccactcctcgactacaatggttatgcctaccgcaacatcaaagtggacggattttacctcaacgatgcgttccgtggaaaactatcgttagacgacccaaatggtagaatttacattgacggaacggtgggaaatattcggaaattcatggcaaagcaggcaaaaatcaatgtagatgcgcaaatcaatgccaaggctgtgaatcttcataacctccgtctgaccaatgttttaggcaatcgctcgttcacattcaattcgaaaattgtcggcagtggaacgaccttagacgatttgataggacaattatcaatagacgacttcactttgcatgagccacatcgtaatattaaggtaaatcatttggatttgaaaacatcagttagcctgttgaataagtccattacgcttaattccgactttggaactgcttctatttcaggacgtttcaactataaaacactcgttcaaagtattaaaaatgtggtgggaacctatcttcctgcgatagtaggcagtccgcaacgttggacaaaaggagtgggcaacaatgctttcactctgactgccaacatcaaaaataccgacttgttgcacgaattggcgaaagttaaagtggatattccacaatatttaaatcttaatgccaccataaacgaagcgcgtaacgcattggatttaagcctcaatgcgcctcaaatcacttacgctaacaacgaaattgaaaatttgcagttagatattacaacgcaaaacaaggggttggacattcagttacagggcaatcgtactgacttttcggggcggcacatttcactaaacacgcacgctatcgctcgcaacaaccaactacaaacgctgtcttcattcgatacgcatggaaaaaaaactatccgtggacaaatcaattgtgcggcttcgttcaagcgaacacgaggaaatttggcaactcatctccacttctcgccttcgaaaattatggtcgatactataggattggaggttcaaccttccgatttaacctattcgcacaacaatttgtatatcaattacttcgaattatcgaataaagcacaacatattattataaatgggcaagcatcgggcaatccgtctgactccttaatcgtccaactcaaagatattgatgtgccgtatattctcgaagcagttaatttccatagcgttacattcgacggtatcgcatcgggcgaagttgccattaaatcgctttttaccaatctgcaagcgcacgcaaaacttaccgtaaagaagtttgaatttcaagatactgacatgggaacgctctttgcagacgccgattacacccatagcgaagggcgcattaatgtggacgcaaaagccattagcgacgataacacaaccgatgtgggcggatatattgacatcaaacgcaagtatattaacttgccaattactgcccacgatacaaaattagacttcttgaacaaattttgcaaagcctttatggataatatcaacctgcgtggaaacggttgggtaaaggtggttggaccactatctgatgtaaatcttgaaggcgatgtgctggcttcggggtctgtacgactaaaagctctcggcacaacctacacccttcatgagggcagagtgcgccttattccgaacgaaatatactttgaacgtgatacagtctacgatgctgacggcaacattggcattgttacgggcggattacaccaccaagcgttgcgacatcttacgttcgatattgatgtaaatgccaagaatttaatggtttacaactatggacggtacgacacaaacaatactttttggggcaaagtatatggcaatggaacgtgccaactcattgggcgagagaacgaaacgactatcaatgtgaacatggaacccaccaaaaattcgttcataacctacaatgcagcaaaaaattctattgacgaaaattcgttcattcgttggcgtgatatgacgccagacacgctttcggcaaccataactcaaaccacacaatggcaaaaacgcgactcaattgacaataatatctcccctattgcaagcgatttgcacatcaattgtctcatcaatacgaatcctaatttcacactcggtgtacttatggacgaggcttcgggcgacaatattgagctcaatgggtcgggtgtcattcgtgctacctactataataaaggcgcattcaatctatttggcaattacaacattgaacgaggacactataatttcaccattcagaatatcattaaacgccaatttgctttccaaactgggtcgttaatcgccttcggaggcaatccgtttgatgcagcactcagtctgaaaggctcttatatcctcaattctgtgccgctatccgacttgcaaatgggcaattcgttccgctcaaacaatacagaagtgaactgtctgttagacattaacggcacacctgggacaccaaaagttactttcggattggacttgccgaacctttcgtcagatgcaaagcaaatggttttgtcggtactcaactcggaacaagaccttaaccaacaagttctctatttgttggcagtaggaagattctacccacagacctctaacaacgctgcacaaggcacatctggacaaaaaggacaggcgtcgcttgtgatgcaaagtattctttcgggaacgctatcgcagcaaatcaacacaattctctcgaatgttatcaaggataatcattggaattttggtgcaaatattgccacaggtaacgacggatttagcaatgccgaatatcaaggaattctgtcgggcagtctgctaaacaatcgtttgctcatcaatggcgagtttggttatcgcgataatgtaaccaccaacacatcggcatttatcggtgatttcgacatcaaataccttttgacaccaagtggaaacatagctctgaacttctacaaccgagccaacgaccgatatttcacccgaaattcgctcaacacacaaggtattggtgttatcatgaagaaagatttcaccaacatttgggatttatttggtgtcaagaaaaagaagaaaaagaaaaaataa

SEQ ID NO: 2323 - DNA, 1341 bp, Prevotella disiens
atgaaaaagtttattgagacactgaagaactgttggaaaatcgaggatttgcgcaagcgactcctcgtgaccatcctgttcacagccatataccgttttggctcgtttattgtacttcccggaattaatccgagtttgttggaaaaactccagtcacaaacagctggcggtttgatgtcactgttggacatgttctctggtggtgctttctccaaagcttctatttttgctttgggaattatgccttacatttctgcttctatcgtaatgcagcttttagctgttgctgtaccttatttccaaaagatgcagcgcgaaggagaaagtgggcataagaagattaattggtatacacgcattttgacagtatttattctgttattccaagcgcctgcatacttgattaacttgaagacacaggcagcgggcgctttggcaacaggagtaaactggactgccttcatgttctctgcctcaataatcttggccgctgggtctatgtttattttatggctcggtgagcgcattacggataagggtgtaggaaacggaatttcaatcattattatggtcggtatcattgcccgacttccacaatctttcttccaagaagtaagtagccgctttacagcgattacaagtggtggtcttgtaatgtttatcgtagaaataattatcctatacttggtagtgtgtgcggctatccttcttactcaaggtacacgcaaagttcctgtacagtatgcaaaacgtgttgtgggaaacaagcaatatggtggtgcgcgtcaatatattcctttgaaattattcgcagctaacgtaatgcctatcatctttgcccaagcattgatgtttatcccattgacaattgttcagttctctactgatagtgcaagtcctgtacttcaggctttgatgaatacaaagagtttagcgtataatttaatctatgttggtttgataatcgcatttacttacttttatacagctatcacactcaaccctactcaaatggcagaggatatgaagagaaacaatggatttattcctggtgtaaaaccaggtaagagtacagcggaatacatagatacggttatgacccgcttgactttccctggctctctctttatagctcttatagcggttatgccagctttagcaggtttgctcaatgttcaagattcatttggtcaattctttggtggaacatcattgttgattcttgttggtgttgttattgatactcttcaacaaattgaatcacacttgatgatgcgtcactacgatggtcttttgaattctggtcatacacgtggcaacggcaatgtagctgcatattaa

SEQ ID NO: 2324 - DNA, 2286 bp, Prevotella disiens
ttgaatatgaaaaaactactattcacagccttgctattgttaggctttcaagcagcgatagcacaacacattacaggaaaagtaaccgacccaaaaggcgaatcattggcttttgccacagtggcattgctttcttcagccgattcttcctttgttgcagcaacaacgactcaagacaatggtacgttcttgttggaaaccaataaaaaagagggcattcttatggtttcttacataggttataagaatttttatactccctataaaggacaacaattaggtgtgattacgcttgaagaagatagcaaaatgctcgaaggagtagtgataaaagccaatcgattggtaaatacagcaaatggttacagctttcgtcctatcgggtcgggattggaaaagacaaacaaaatacaagatatgctcgcctttctgccaggcttaacaataacggataataaaatttcattgttcgataaatatcctgtgatttatgtaaatggactaaaaataacttcgcaagaggagctttctgctctgtcgccaaagttaattgacaaagtggaggtagactatatgtcgattggcgaaggtgcaaacgaaaaagcaggcacactgcgcattaccacaaagaaagaacagaatggaggttactcgggttcgttgagtgccaccatagacgaaatgccaaaatacggacaccttatggactcgcctacctttgtgtttaatgccagcataggacgatggacatttaactattatgccaattatactcaccaaaaactattggccgacgaaaccaataagtatgttttcaattcgggaaaagtaactttcaacgacagtaaaacacgttcgtggctcaatgccattaacacacgtctcaacattagttacgaattgagcaagcgtgctacactcgccttatcggaatatgttggcaataaggatattaaaaacaaactcaacacgcgtgtaaccatgatggaaggttacggcattgagcctaaaactttcaataatttcttgtatagtcctgaaagcaagtttgttcaacaaaccgtaggaaaatacattttgcaaaccgatgaacgtggttctaaccttgaaataacagccgattattatcatagaaactatcatttgaagcaaaaccaatatgtaaacgatgggctaaaggcagaaaccaaaacgcacgaacgcatcaatatgtacagcattgcaccaaaactaacacaacgcttccaaaacggaaaagaactgaaaacgggtgcaagctatcaatacattcattacaacgatgccacagaaagccttcaaaacaaggtgggcgcacaaaaaacatacgcttacgccaatctttcgggacgcataaagaagatgatgtatggcgtaggacttaccttacaatacaaccgaatggacgttcgcacaaacggaacacagaccattgtagacaacacttacctttgtccgcaagccaatcttgcatgggctatcaatccgaagcgaggaacaatgctgaatttcatgtatcaacacaacgtagccgaaatgccttacagcattgtaaacagctataaaaactttgagaacccacaacattacaccacaggaaatccctctttgcgcacacctaccgaccaccaattcatggcacgctttgcctttaatcgccatttatcgtttatgtttatgtatgacagagtagccgatgtcatttattatcaacatggcatagatgccaacgacccttccataacatgggcaaagccagccaatgcaaaatatgaacgcatgatgggcgcacaagtggaatacacttgcaaacctacaaagtggtggcaaacaaaagtgcaagccgctgcgctacaagataagtttgccacagcagagaaaaccattacgggaaaatggggaggaaagttttggtggaacaacaatttcaatttctctgaaacctttggaggctcgctcaacggctattgggaaacagcgatgaccttcgaaaaccatgcattccgcccagtaggcaacctcaatgcttcgctttggaaaacgcttttcaacgacaagttgcgcctttctatggaatcgacgctttgcggacgtggacgcaaaaataccatttacggcgatggtttcacttcatactaccacaatgcaacccaccctacctcatttacctttactgcaaaatggtatttctcaggaggaaagaaagtaaaacaacgccacgaagctgaaagtatacaggagtataagaaaatcgaagaaagaaaataa

SEQ ID NO: 2325 - DNA, 1932 bp, Prevotella disiens
ttgcatttttttaatatgaatatttatatgaatttttttagatggtatttctctagaaaaactttaccatattggacgattttattgattgatagtatgatatgctatttttcaggattgctgatattttggctttactatcatggtgcaattgctgttgaacatatttatttattgactaaaactatttttgtttacatggtttttaaccttgtaggctttagggttttccgtacttattcgggtatcatacgttattcttctttcgttgatttgcagcgtgtaagtttagcaatgttattatctctttcattagcagaagttatgcattatatgatttttgcgtggaaaatgaattttgtaccattacaaggtcggcaaatagcagcaatgtatcttgttgcaaccattggaatgataacttttcgtattttggtaaagacaatttacgatgttaccatgaatcccaatcaaaaattgcgtactcttatctatggtattcatgaaggcggaatagggttagctaccaatattcacaacgataaaaaaacaaaattcttattaaaaggatttatttcacatgatgaaaagtattttggtaaaaccctaatgggcgaaaaaatctttatcatagataaattctttgaggagcatcttcatgaaatgaacattcaagcggttttggtttctccgcttcaggttaaacgttttcgtgatgacacacatttgcaggatttattaatcaatgcaaaagtgcaaatttacattactgaaatgtcgaaagaatggagtggaaaagaagattttgagcatgttcaattgaaagaaataagcattgaagacctattgcctcgtgatgaaataactgtcgatatggacgctattggaggattgctgaaagataaacgtatcatgataacaggttcggctggttctataggttcggaaatggtacgtcaagtagcaatctatcaaccagcacaacttattctaattgaccaagccgaaacgcctcaacacgatattcgattaatgatgcactctgatttttcgaacattaaggttgaaaccattgttgcaaacattgctaatttcgaccgaatggagtccatttttaagcaatataaaccagaatatgtgttccacgctgcagcttataagcatgtgccgataatggagaataatccttctgagagcgttcaaaataatatttggggaacaaaagttattgccgaccttagcgttaagcatggtgtgaaaaaatttgtgatgatttctacagacaaggctgtcaatcctaccaatgttatggggtgttctaaacgtatatgtgaaatctattgtcaaagcttaaatattagcttaaataaaaatggagtagtttctggaactcaatttgttacaacacgatttggaaacgttcttggttccaatggttcagttattcctctattcaaaaaacaaataaaagcaggcggtccagtaactgttaccgacccaaaaattatacgtttcttcatgcttattcctgaagcatgcaaattagttttagaagctggaacacatggaaaaggtggtgaaattttagtattcgatatgggtaaacctgtaaaaattgctgatttggcacagagaatgataaaactttctggcgcagacgatgttcatatagaatatacaggattacgcgcaggcgaaaaactctatgaagaggtgttgagtaccacagaaaatacattgccaagtttccacgaaaaaattcgcatagcacaagtgcgtgaatacgattacaattctgtaaacgctgatatagaagaattaattcgcattagccatacatataacaatatggaaattgtgaagaaaatgaaagaaatagtccccgaatatgtcagcaataatagcatctattctgcattggacaaaaaataa

SEQ ID NO: 2326 - DNA, 1203 bp, Unknown
  Description of Unknown: Ruminococcaceae bacterium D16 sequence
gtgacaataaaaaaatctttcgaggaatggggcagatcaccgggggacggaggtttgttcggcgagagggagacagaaagaaaaatgaatattattttgaataattcgattttatctgtggatatgaaacgagtacggcgcaacgtggctaccgttctggaagagctgcagggagcgcagctgatccctgtgctgaaggataacgcctatggcctgggactggaggccatgggccatgttatggaggaatttccccagatcaccactctagcggtggcccaggtgggggagggcgcggctctgcgccaggcgggcatcacccgggagatcctgatcctgggcggtgtgcccgcccatttgctgcgcgcagcggtggagctggacctcacgctgtcggtggggcggctggagcttctcccggtgctggcactgctgggacagtcggcaggccggcgggtaaaaattcaaatcaagatcgagaccgggctcaaccgcaccggcgtaatgccaggggcggagctggcccatctgttggaggagtggcgaagcgcccggaatcatttccagatcatgggcgccttcagccactttgccgacctggaggacacagagcggacccggcagcagtatgagctgttcctggaaggtgtggagcagctgcaggcgggaggaatggagatccctctgcggcacatttcggccagcgctgcccatgagcagttcccccaataccggctggacggggtgcgcatcggccggcggctgtacatggaccaccccactcagcccaccggacgggtgagtgaaacggctacctggcgcacctggatcaccggccttcgtactctccaggccggctcgcccctgggttacggcggaaaggtatttctggagcgggactccactgtggctaccatcgccgtgggatacggcgacgggctcagtgaagagttggtacgggtccatgggccggtgctggtaggaggagagcgggcccggctgatggcctgctgcatggatcagactttggtggacgtcaccggcattccctgccgggtgggcgacccggtgaccctgtttggctgggacgaacagggaaacctgctggcatctcaggaggtggccctgctggtgggagaggacgagggctgcggactgactgcccagctcagcccccgggttgcccggatttacagcaaataa

SEQ ID NO: 2327 - DNA, 909 bp, Unknown
  Description of Unknown: Ruminococcaceae bacterium D16 sequence
atgaatacccgagagcaggaatatatgctggctctggacaagacccgcagcatcactcgtgccgcagagcagctccatgttacccaacccacgctgagcctgtttctgaccaacctggaaaagcggctgggaacccctctcttccatcgtctgggcaagaaattagtgcccactcaggtgggagaggcctacctgcgccgggcacagcagattgtggcgctgaagtatgactttgagatggaaatgagcgacctgaccagcgggcggcagggtacactccatgtgggcggactgcgaaaaggaaacctgtttttgatgccccggctcatacgccgctttcgtatggactatccgggagtggatgtaattttgcacgaagacactgccgaaaatttagaacatgcgctgtgtgctggtgaattggatcttatctacatcaatcagccccctacccacagcggcctgcatgtagaacacgtacgtcaggaccatatgctgatggtactgcctgccgatcatcccgctgtccggcgcggccgctggctggagggctgtcactacccctacttggatctgcaccatgtggaacaggaagccttctacatgctggaagagggccgcagcgtgcgcgtggtagcagatgccgctctgcgctacgccggagtggaaccccgcaaaatctatctggtcagcaatattgagctggggtgccagatggcagcagaggggttaggcgtggccttcaccatggagagctaccgccgggaacacaactatccccatccggtgagctatttccgggtgggcgatcccaactactatctcacctggaatctgatttggcgtgaggaggccttccgctccacctacatggaggactttatccatctgctcaaacagtttgcctga

SEQ ID NO: 2328 - DNA, 675 bp, Unknown
  Description of Unknown: Ruminococcaceae bacterium D16 sequence
atgaaacgtatcctgattgtagacagtgatatggctgtccgcggccaaatcggccgccacgcacgcctggagggatacgaggtcgcggaggccggtgatggctacaccgcggtttccatgtgccgccaaaatgcgtttgatattattattttggctattcttttaccggaaatggatggattttcggtatgtcaaacgattcgcagcttttctcaggtccctattttaatgcttaccgagcgcaccagcgaacaagaccgtattcacggcctggaactgggcgccgatgattatatgacgaaacccttttcccccagagaattgatgctgcgcatttctgctatcttaaagcggggcaagtccttggattccctagagccccaatccattgaacgagacggaatttatatcgacctgaccgcccgccgtgtccttgtagacggcacgctggtcagccttaccccaaaagaatttgatcttctgaccctgctggccagccacccagatgtggtattttcgcgaaaaaaattactggatacagtctggggcggcgaattgcctgaggatacccgcacattggatacgcatatcaagcaggtacgtcacgcaatttctccgtatagcgaccgtattgttactctgcgcggtgtaggatatcgctttgaaaaaacctaa

SEQ ID NO: 2329 - DNA, 609 bp, Unknown
  Description of Unknown: Ruminococcaceae bacterium D16 sequence
atgcaaaaaagaaccagcacactgactacaaccagcccgctccctcttgtctttccgggctgtgtcgggtataatttcaaaaaagaacgaaagaaggtggcccccatcggaaaaagattggcttgggtgctggcctccgccctgctgctcaccggctgcagcagcggacagaatgacacagaccagcacttttccctgggcgacacagtatccacggcgtggtttgattatacggtaaccgaagtagaatccacccaagagtacggcggctatatcagtgcgcagggggatcagctggtggtggtggagttgactctgaagagcacgtaccctcaagcggtaactatgttcgacagcgattttcagctctcctgggacagtatgagccaggatgatacccggtgcatgccggtggagtactactgtgaccagcagcttcccacagaatatgagctcgcccccagagagagccgcagcggcgttctggtctatcaagtacctgacgatcagagcacctttcaatttaccttccaggagtttttcgatgatggaacgcaggaaggccgccccggcgatcaatacgtgatggatctcaccccgcaggcgtaa

SEQ ID NO: 2330 - DNA, 1659 bp, Unknown
  Description of Unknown: Ruminococcaceae bacterium D16 sequence
gtgtgctattttttaggagggagcttttttatgtacttattcaggccccagcttctggagtcgttggcggactattccagagcaaagtttatgaaggacctggtggcaggtatcattgtggccattattgccctgcctttgtccatcgccctggccctggcgtccggtgtttcgccggagcagggcttgtatacggccattgtagcgggatttctgatctcggccctgggaggaagtaaggtccagatcgccggtcctaccgcggcctttgcctccattgtggcggggatcgtagcccgcaacgggatggacggtctggcggtggccacggtgctggccggtatcctgctgatcctgatgggtgtgctgcgtatgggcagcatgatcaagtttatcccctacaccatcaccaccggatttacggcaggcatcgcggtgaccattgtggtggggcagctgaaggatttctttggcgtcaccttccagaactcacccgttgagacggtagaaaagctggaggagttttttgcgtgcttttctacctggagcatgagcgctgtggcggtgggatgtgtggcgctggccattcagatcatctggcccagattttttgccaaaatccctgcctcgctggtggcggtggttgtcacggcggccatggtcaagctgctgcacctgcccgtgaacaccattggagatctgtataccatttccaccgatctgccccaatttactctgcccacggtcaattatgatatcgtggcggcggttctgcctgatgcctttaccatcgccattctggcggccatcgagtcgctgctgtcctgcgtggtggccgatgagatgacaggctcccatcataactccaacatggagctggtagcccagggcgtgggcaatacggcgtctgcgctgtttggcggcatcccggctacgggagccattgcccgtaccgctgccaacattaaaaacggcggcgtgtccccggtggctggaatggtccatgcgggggtgctggtgttggtgctggtgctgctgatgccctatgcggcgctcatccctatgccctgcattgcagccatcttgtttgtggtagcctacaatatgagcggctggcgcacctttgtgcgggtggtccgccagtctcccaagagtgatacggcggtgctgctgctcacctttttcctgacggtggcctttgacctggtggtggccatcggcgtgggtctgactctggcctgcctgctgtttatgaagcggatggccgatgtggccgtggtggaagagtgggaatatgtggaggacacccaggccggaaagggacggttcaagcatgtgcctgtccatgtgatggtctatgagatcaacggtcccatgttctttggtgcggcggataagattccccatatcgacgaggggggagagaaacgggtgctaattttacgcatgcgaagtgtgcccgctctggatatcaccgccctgaaggggcttcggcggctgtgggaggagtgcggccgtgccggagtgcagcttgtcttttcccatgtgaacgagcagcccatgtcggtgctgaaaaaatccggactttaccagcaggtagggaaggagaatttctgtcccaacattgacgcagcgttgaagcgggctatggagctataa

SEQ ID NO: 2331 - DNA, 843 bp, Unknown
  Description of Unknown: Ruminococcaceae bacterium D16 sequence
atgaaggtaaccgtcttggtagaaaacactgccccgcaagacagcgggctcaccccggagcacggcctgtccctgtatatccagtaccgggagcataacatcctgctggacgccggctgttcccaggcctttgcccaaaatgcccaggctctgggggtagacctcaagcaggtggacctggctgtcctctcccacggccactttgaccacgcagacggtctgcgctactttttggaggaaaatcccacctgcaaggtgtacgcacggcctcaggccggcggtccctacttctccacctccactggctctccccgcttcatcggtatccaccgggacatctgggagggccacccggaccgctttgactgcggagagggagtgcgtcagcctgttcccggcatgtggctggtgcctgagaccgtccacggtggtcccttcgccagccgggagaccaatctgctgcgcaagctgggtcccgaccagtttgtccaggacgacttcatccatgagcactccctggtgctggagggggaggatggcctggtggtcttcaactcctgctcccacgggggcatcgtcaacatcgtccagggggtacaggaggccctgaaccggcaggtcaccacggtggtgggcggcctgcacatgttcagcaccagcaccctctccggcctcaactgtccccctgagtaccccggccaagttgcccgggcactgaaagagcagggagtacggcgggtatacaccggccactgtaccggtgagaccgccctggctctgctccgggaggaactgggggacgctttggtaccccttacctgcgggttgaccttctccctgtaa

SEQ ID NO: 2332 - DNA, 651 bp, Unknown
  Description of Unknown: Ruminococcaceae bacterium D16 sequence
atgaccgttcccctccttcgttttcttgctttttctattttaccacctggcgctgtatggggaaaggcaaaaatctacatcctgtctggaaattccccgttgtacccaggcagagaacatgataaaatagagtccatcttacttgtattatgtcgcctttcaaggagttttcttatgctgtacgccctgcttgtggccgctctggtggccctggaccagctggtaaaatatctggtggttcaaaatatccccctggggcaccacgtgccctttctgccctacattctggacctgacctacgtgcagaacaccggggccgctttctccctgtttaacgagcacacctggattttgactctgatctccctggtgatgtcggtgattttggcggtggctctggtgaaaaagttcttccgccatcctctcggccgggtgtgtctggctttgctgctggcgggagccgtgggcaatctcattgaccgggcgcttcagggctacgtggtggacatgttcaatgtgctgtttatgaactttgccgtctttaatgtggccgacatctgcgtggtggtgggcggcatcggagccgccctgtactacctgctgctgtgggacaagctggagggacccaagtcccgggagaacaacctgtga

SEQ ID NO: 2333 - DNA, 867 bp, Unknown
  Description of Unknown: Ruminococcaceae bacterium D16 sequence
atgatcaccgcgtaccataaggaatacagcgactgcctgggccgggatatggaattcaaggtctacggttccggcggtaagcctgtgctggtcatccccggcgagaagggccgcttcttccagtgggaggagaccgggatggtggaggcgctgaagtcggagctggagcggcaccgcctgcagctgtttgtggccgacaccatcgacgcggagacggtgtgcaaccagtggggcgacccctaccaccgggtgcgcatgcacgagggttggtaccactatgtggtggatgaactggtcccccgcatcggtgagctgaacgccaccgggcaggatctgctggtggtgggctgttccatgggcgcctaccacgcggccaacttcttcctgcgccgccccgacctgtttgacgggctgatcgccctgtcaggcgtgtacgacacctatgggatgtaccagggctacatggatgaggtggcctatgccaacgccccctgtgtcagcctgtccggcatggctctggaccacccctatatcgatatgttcaaccgtcggcgtatggtgttctgctgcggacagggagcgggggaggaagcctccctggcagctacccgccgtctggagcaggtattcctgcgcaaaggtattcgggccagaatggactactggggctttgatgtggatcacagctggttctggtggaacaagcagatgccctactttttgccctatgccctgggagaagagccttggccgcccagagccagagaggaccgggaggagccggagcacgcctattatccctactatccttactcccccttcccgcccagagagcggctgctctactttgaagaggactttgattaa

SEQ ID NO: 2334 - DNA, 1116 bp, Unknown
  Description of Unknown: Ruminococcaceae bacterium D16 sequence
atgatcatcggaaacgcaaatgtatttgtagacggcaagttccagaagggctctgtggccgtggagaacggcgtcatcaccgccatcggccccgccggatggccttgtgatgtggatgcccagggcaagtacctggtgcccggcttcatcgatgtgcatacccacggtgccatgaacgaggacttctccgacggtaagcccgagggtctgcccgccatgtccaagcactacgccgctcacggcgtcacctccttcctggccaccaccatgactctgaaggaggaggttcttacccccgccatggagaccatccgtggttttgtccgcccggctgacggtgccaagtgtgcgggcatccatctggagggtcccttcctctcctacgccaagcgtggcgctcaggccgctgagaacctacacaagcccgacgcggagatgttccaccgcctcaacgccgccagcggcggccaggtccgcctggtcaccgtggcccctgaggaggagggtgctatccccttcatcgaggaagtctccaaggtgtgcaccgtctccatcggccacaccaccgccaactatgagaccgccatggctgcctatgcggccggcgcctcccatgccactcacctgtataacggtatgccctccctgctccaccgtgagcccggcgtcatcgccgccgctctggacagcggcgctaccgtggagctcatctgcgacggcctgcacatccaccccgccgtcattcgtgccacccaccgcatgttcggcaagaagctggtcatcatcagtgactccctgcgctgcgcgggtatgcccgacggccagtacgagctgggcggccagcccatcgagatgaagaacggccgggctaccctgctgggtaccgacaccctggccggctcctcctccaacctgctgcaggagctgcagaacgtagtctccttcggcctgcctctggaggatgccatcaccgctctcacctccgcccccgccaaggcggtccggctggaccacgagatcggttccatcgctgtgggcaagaaggctgacctgctcctgctcaccgaggatctggaattggattccgtctacatcgacggcaacaaaatcatttaa

SEQ ID NO: 2335 - DNA, 1926 bp, Unknown
  Description of Unknown: Ruminococcaceae bacterium D16 sequence
gtgatgcgagatggatttatcaaggtagctgccggtacgccgaaaattcgggtggccgactgccgctataacgcagagcagatctttactctgatgcgggaggcggataagcagggggtcaaggtgctgtgcctgcctgagctgtgtctcactggatatacctgcggcgatctgtttttgcacgacacgctgctgaaaggtgcggaagagggactccagacgatcctggaggccacccgcaatctggaactggtggccgcagtgggtctgccggtgcgggctcagtatgacaataagctgtataactgtgctgctctgatccagaagggtgagattttgcacctggtgcccaaaatccacatccctaactatggagagttctacgaggcccggtggtttgccagcggcgctggggtagacaccacggtgactctgtgcggccagcaggtgtgtatgagcaccaatgagacttttgcctgccaggagatgcccaacctcattctgggtgtggagatctgcgaggacctgtgggctcccgagcccccctccgccggtctggcccgcagcggagccaccattatcctgaacctgtccgcctccaacgagacggtgggcaaagcggcctaccgccgccagctggtcaccggccagagcgggcgtcaggtgtgcggctatgtgtatgccgacgcgggtgagggcgagtctaccaccgacttggtctttgccggccacaacatgatcgcggagaacggcgctttgctggctgagcggcgctttgccaacggtctgaccatcagcgagatcgacgtggaccggcttgcctatgagcggcggcggatgacctcctttactcccgacccggacaaggaatattggcgcggcgagttctccctcaccctggaggagacccgactgacccgctttgtctcccccagcccctttgtgccccaggacgagggcgaccgggccgagcgctgcaacgagattttgtgcattgctgctctgggcctgaaaaagcggctggagcacacccacgctaagacggcggtggtgggcctgtccggcggcctggactccaccctggcagtgctgattactgctgtggccatgcagatgctggatcgtccggccagcgacatcattgccgttaccatgccctgcttcggcaccactgaccgcaccaaatccaacgcggtcttgctggccgagcggctgggctgcaccctgcgtaccatcgacatcggcaacgcggtgaagatccactttaaggatattggccagagcatggaggaccacagcgtcacctttgagaatggtcaggcccgggagcgtacccaggtgctgatggacatcgccaaccagaccggtggtttggtcattggaaccggcgacctcagtgagctggctctgggctggtgtacctacaacggcgaccatatgagcaactacgccgttaatgcgggtattcccaagactctggtgcgtcatctggtgtcctttatctccgacgacaaggcccaggaggaccgccagctgtccgatgtgctcagtgacattctggataccccggtctctcctgaactgctgcccgccattgagggcaagatcagccagaaaacggaggatctggtaggcccctatgagctgcacgacttcttcctctatcacattctccgctggggcttctcgcccaagaaggtgttccggctggccctgtatgctctgggaagccagtacgaccgggcgaccatcctgaagtggctcaagaatttctaccgtcgcttcttctcccagcagttcaagcgctcctgcctcagcgacggacctaaggtgggctctgtggccctcagtccccgtggcgactggagaatgccttccgatgcagtggcctctttgtggctggatgagctggaggggctggaataa

SEQ ID NO: 2336 - DNA, 564 bp, Unknown
  Description of Unknown: Ruminococcaceae bacterium D16 sequence
ctgcgactggctaccccaatggatgcccccgcgctggtgggcatctatgggcagtatattcataccccaatcacctttgagtacgagctcccctcgccccgggagtttcaggaccggatcacccatacactggaaggctacccctatttggtttgggaggagaatggcactcccgtgggttacgcctacgcccaccgcttcaaagagcgggccgcctatcagtggggtgccgagctgtccgtctatgtggcccagggccacacctcccaaaaagtaggccggaagctgtatggcgctctgatggaactgttggcgattcagggagtgcgcacggtgtacggcatcgtcaccgttcccaacgagaagagtgaggggctccaccgcagtatgggctttcaggacgcaggcatctgccgtaataccggctatgtggacggagcctggcgggatgtgcagacctttgagaaggccatcggcccctacgacctggagcctgtccccatcacccccttcccgcagctctccccggagctggtccaaagggttctggcaaaatggcagtaa

SEQ ID NO: 2337 - DNA, 1089 bp, Unknown
  Description of Unknown: Ruminococcaceae bacterium D16 sequence
atgagtttctcccttcccaaataccaggcaccagattttgctgctctggggctggacaacgcgcccgatgtgcagttggtcccggcagagaaagacggtgtgatgcctgaaaactatcacgccaccactatgttccccgaatatttccgcatcggcggacaatgggtgctggcagaggacagccggatggactgcgtggctgtagtccgggagggcaaagtgtccgtggtggaatttcgcaatgtgaagcagggtgatctggtggcagtaggccggtctgaggatggctctcagggcatctatgtccacccggactgctttgtagatgagcagggagagcaggaggtttttgccttccgtcagggccgcagccgggagactgcttactccgtggactatgataacctctatcagctgctgcgctatgagcggcagcacggcaatatcctgtgggtcatgggtccggcctgcgtctttgactcccggtcccgggccgcttttgctgccctggtgcgccagggctatgtcaacggtgtcatggcgggcaatgctctggctacccacgatctggaggcaggctatctgggtactgccctgggccaggacatctacacccagcagtcccagcccaacggccactataaccacatcgacaccatcaatgaggtgcgtcggatggggtccatccaggcctttgtggagtctggcaaggtaaaggacggagtgatgtaccagtgcgtacaccacaatgtgccctttgtgctggttggctccgtgcgggacgacggccctctgcctgaggtgtacggtgacgtctatcagggccaggacgccatgcgcaacctggtgcgaaacgctaccacgatcatctgtatggccaccaccctgcataccgtggccaccggcaatatgacgccctgtttccgggtcgtggacggagaggtgcgccccctgttcttttactcggtggatatctctgagttcgcggtgaacaagttgcgggaccggggaagtctgtcggtgaaaaccatcgttaccaacgtgcaggactttgtggtccatgtcaaacagaatctgttgggagaataa

SEQ ID NO: 2338 - DNA, 1071 bp, Unknown
  Description of Unknown: Ruminococcaceae bacterium D16 sequence
atggatcattgctccgacctcaccagggcgcccggcgctccaaaccaggtccgcatcccctatctggacgccctgcgctgtctggccattcttcttgtcatcgcgctgcatgtgaccgcccccatcatggtcagccccaccctggcgcaaaccaatacctggcttgcttgcatggtgctggacccgctggtgcgggtgggtgtgcctttatttttgatgatcagcggctgcctgatgctggacgatccccgctccagagagatcacacccttttacaaaaagcagctgcctaagctgctgatccctctggtggtctggaatgggatctacttcgccgtggcggtcctcaccggctcccagcccctcagcctgtcggtctttctgcagcttctcctgggccagggcgtgaagtaccacatgtggtacatctacatgctccttggcatctacctgatctgccccttcctgcggcggctgatcgagacctgcaccccccggcagattctgcttctgtttggcatcattctgttctcctccaccctccgtcccgccctcaatcaggtcctccctttccaggtggtgctgtttggccctatgctggagggactggtggggtatgtcctgttgggctggctgctggggcggcaggagctgagccgccggacccggcttttgatctatctgggcggcgcggcaggatatgccgtgcatttggtggggaatctgctctacgcctgcccggaacagagctatctcccctttgaaagcggctacgccttcccccactatctcattgccgccgtcctgttcgtgtgggtgcgcaccttcttttcccaccacgcccaggcgctgcgcccggcccaaaagcccctgcgcctgtgcgcccaggtggtctttggcgtgtactgggtccaccctctggtgctggacgttatcacccatctgcagcccgacgctctgcctctggctgccgctctggttttgcagggcgtgctgaccgccctgctctccttcctgtttgccgcctgcgtgtccaggatccccctgctgcgccgcctgctccagggataa

SEQ ID NO: 2339 - DNA, 903 bp, Unknown
  Description of Unknown: Ruminococcaceae bacterium D16 sequence
ttggatagttatccctggacagacccctctgtcccctggtttaggaggccaatcatgagaaaagactttgccctgcccgctcttgccctggtgggcggcgtggcgggctttgcagtacggctgtggcagcgctcctcggcgctggatcccacgaccaacctgtttacccacggcgctcccgccacctgggctctgctggccctgacggcggtcgttgccgttttggcgctggtcctgtgctctggcggtcggaccatttcggaagaggaagccgaccgtgccttccagtgttcctccaccggttatatgacccttatggtggtggcaggcatgggctttctggtctcggcagctgccggcgttcctcagctgatggaggatctgcaggcctggcaggctgatccctcccggcatctgttgcctgcggcgctgggtctttccattctgggctgtgtggccggtgctatcggctctctggtgcttggaaaatccaactaccgggcactgtccggtgagcaggtccgtctggcagctactctgcccgcctacgccgctttgccctggctcattcggctctaccaggtctattccagtgacccggtcctgcttaattcctttgttcccctgctggccgcggttttcctgctgctggctctccacggccaggcggctttcttctaccgccggccccgctgccgcagttttaccgtttttgcagtgatgggcgtctactttgggcttaccgctctggctgaccgcctgtccctgtttgattccctgctggcaatctcctttgttgtgtgtagcttcggcgctctgacggctctgtccgcccggcgcttttctcccactcccctgggtccgcgaatgccccaggaggatatggataatggaacaatttga

SEQ ID NO: 2340 - DNA, 972 bp, Unknown
  Description of Unknown: Ruminococcaceae bacterium D16 sequence
ctgataaaacttaagttatccttttttaaagggggtcagaccgagatgccgtacaatatcaatttaaagcatctggagtgctttattaaagtggcccagctgggctccatcaacaaagcggcccaggctctgtttatttcccagccccatctgggcaagatcatccacgacctggaaaacgagatgggctatcttctgctcaaccgcagcaaccagggggtcaccctcacgcccgagggggaggaatttttaaagcatgccgcccgggtgctggaggagatgaactgtctgcggcgacccagcataaaaaccgcggaatttaaccatctttccgtctctatgaccaagttttctcatgtaatggagagctttatcgaagtggtcctcaaccaccaggaccagccctccttctcccaccggctctacgagggcaacgccgaggaggtcatcgacgacgtactctccggccgggccacagtgggggtatttcactttgacagcaagcgccgccgggagatggaaaagctgctctcctcccagcggatggtctaccgcagtctggcctatgtggagccccacatcgtcatctccaaaaaccaccccctggtgcgccagcacaagcccattaccctgcaggccctggctccctacggcatgatccgataccttggccagtatgacgacctggctcacaacctttttgaaacgcagctccagggcatggagagcaacaattccaaggtgatctacctgtccaaccggcagtctctcatgcgcctgatttctgtgagcgacttttacagcatcgggatccacgacttcgagatgcaggatgccggctacaaggccatgtcggtccccatcagcggctgtgacttcatgtttgagttcggctatgtgaaaatggagggggaaccgctgtcggacatcacccaggaatttattgaaaatgtaaaagccagactaaattaa

SEQ ID NO: 2341 - DNA, 1938 bp, Unknown
  Description of Unknown: Ruminococcaceae bacterium D16 sequence
atgggagttgcagatctgctcagtccacagcgcatcgaattgaatcttcccctgcaggacaagcaggccgtgttggagcggctagtgaagttggaaggttatggagaggccatcctggacctggaggcctttcgccgggacatgatggcccgggaagctcaggggggaacggcggtggaggccggtgtggcggtgccccacgccaaatctgcagcggtacgctatcccagtcttgcggtggtcaccttgagagaaggaattgactgcggggctttggatggggtgccctcagatatcttttttatgattgcagcccccgccgacgcagaactccatatggcagtgctggcccggctgaccaggctgcttttggagccggaatttctggagcagctgcgccaggcgatcacgccagaggaatttctggagattgtcgatgagtttgagcagcgcctgccccagctggacagccgatggcaggaggctcccaccgccaaggtgctggcggtgaccgcttgccccacaggaattgcccacacctatatggcagccgacgctctggagcgggcggggcagcgtctgggtatctcggtgaaggtggagacccagggggcgggtggaacaaagaacaagctgacctcgcaggagatccggcagtgtaccgcagttgttatcgctgccggacgggaggtggatatgagccgcttccaagggatcaaggtactgcgggtatcggtgaacgagggaatctaccgggcagaggagctggtacagaaggccgcgtcaggggatgctccggtatacggcggcgtggacttgccccgggaggtggtacgcatcgaacgggcgggcgtacgggcctaccgccagctgatgaacggggtaagccacatgctgccctttgtcattggcggaggaatcctcattgccctggccttcttgctggacgatctgtccctgggctatgcccattttggttccaatacccctgtttcggcctggctgcgggccatgggtcaggcggcgctgagctttatgctgcccattctggcgggatttaccgcggtgtccattgccgaccggcccggcctgatggttggcttcgtgggaggcgcgctggcggcatcgggctccacctttgctgccccggagggatccggcgtagcggcgggctttttgggggctatgatcgctggatttgccggaggctatctgatgctggggctgaaaaaactgctggatcggctgccccgggctatggagggggtcaagcctattttgctctacccggtggcgggccttctgatggtagggctctttatgtgtctgatcaatccctttgtgggggcactgaatgaggcgctgtacggtacgctgcagactctgggaccggagagccgcgtggcgttgggggcgctgctggcggctatgatggccatcgatatgggcggtccctttaataaggcggcctacctgtttggtacgtctacgctggcagcgttagccagcgggcagcgctcggatgtgatggcggcggtgatgatcggaggcatggtgcccccgctgtccattgctctggccaccaccttctttaaaagccgctttacccaggaggaatgtaagtcaggcactgtgaactatattctgggactgtgttttatcacagaaggagcggtgccctttgccgcgggagatccgctgcgggtgctgccggcctgcattgtgggatctgccgtgtctggcgggctatccatgttgtttggctgtgctcttccggcaccccacggaggaattttcctgtgcccggtgatgattaatcccggaggatatctggcagccttggcggtgggatccctggtgggaatggtgctgctggctgtgctgaagaagaaaaaggaccaaccggaaccagagactgtgaaaaaatcgggtcagtaa

SEQ ID NO: 2342 - DNA, 1437 bp, Unknown
  Description of Unknown: Ruminococcaceae bacterium D16 sequence
gtgtgtatgttatccctgcgggaaaccatttgtaaggagagacgagttttgaaaccttccaaagtatgcgccgccatgctgtgcggcgtctttggggcggcgctttttaccaccccggcattagctgccgcggcccccaatgacctgcggcaccactgggctcagacccaggtatacaccttgatggagcacggcatcattgccggctattccgatcacaccttccgcccggaccagccggtcacccgccaggaggcggcaggtctggtttacggcctgttggaggagatgggcgtggaactggacgacgaggcggagatccccgtctttggcggcaccacggaggatatcccccagcaggtgctggaggactgggagaagtatcataactccctccagcgtcccagcgaaccggaagagggggaggaaaacacttccatccccggtaacgatgtgacgttccccacctataccgacctggacgacagctgggccaaagacaagattctgtgtctggaggccaacggcgtgctgcctgaggacggcaccggcctgttccgtcctttccagaacctgacccggggcgaggcggctcagatcctgtataacagcatctgccgctggccagagctgttttccctcacccctgtgaccgagtcgcccgacattcacgacatggacggacggcccgatgcggaggccgtgctgtctctggcccggctgggtgtggtatccggtcgcggcgacggcggttactaccccgacgactccatctcccgggcggagttctcggtactgctgctgaatctggcaggctaccctctgatgaccgacgtggagtttgatcccctgcccgtgtgtacggtgatccccaccccctacatcagccaggtgtacccctccgcggcctgggtgggctgtgagcctacctccctgcttatgggcctgaaggccaagggctacgcccagaatgtgacgctggatcagttcctggccgacctgcctaagacttcttccaacccggccaagggctttgtgggctccccctacgtccccagcgagaccctgcgcaccaccatctatccggctcctctggcggagtacggccggcggtacggcaatgtgaaggacttttccggcaagtccgtagaggaattgcgggaggaagtgcttctgggcaacccggtggtcatttacgtcaccctgtactggaagcagccctattaccgcaatttcaacattgagggtaccacccagagcctgctgcgcaacaaccatgcggtgctggtatgcggctatgacgccaccacccaatactactacattgccgatccctacaacattgacgaccgctaccacgactacttctactggatctccgccgatgttctggatcccctgtatatggtgcggcagcacgcggtggcaattgaataa

SEQ ID NO: 2343 - DNA, 621 bp, Unknown
  Description of Unknown: Ruminococcaceae bacterium D16 sequence
atgaccatcacctacgaatacgagggggcactgtacgtcaacctcaccaacaagtgcaactgcaactgtgagttctgtctgcgccatggtaaaaaagagggctccatctatacggaggactccctgtggctggagcgggagcccacccgccaggaggctctagacagcttcctcagccgggacatccccagctaccgtgaaatcgtcttctgcggctatggtgagcccacctaccgtctggacgatattctctggctggtagacgagctgaaggcccgctacggggaccagttgcccccggtgcgtatcaataccaacggccatgccaatctcatcaacggccgtgacgtgtgcccggagctgaagggacgcatcgataccctgtccatctccctcaatgccaacaacgccgccgattacgtggctctgtgccaccccatccagggcgaggaagcctaccaggccatgctggactttgccaaagagtccaaaacctatgtcccccacgtggtatttaccgtggtggataagggaaccgatcccactgagattgaggagagccgctccattgcccagagtctgggcgtccagctgcgggtacgggcatatatcgactcctga

SEQ ID NO: 2344 - DNA, 804 bp, Unknown
  Description of Unknown: Ruminococcaceae bacterium D16 sequence
atgatccgactcatcgccctggatctggacgggaccctgctggacccggcaggccagatcaccgacgagacaaaagccgccattgcccaggcccgccaggcgggtatcaaggtggtgctgtccaccgggcgctccgtgcaagaagctgccgacttttccgcccaggccgggtgtgacaatttatctgtctgcctgggaggcgccgtactgtcggataacgcaactggcgcccacctgcggcgctgggatattccggcggacgtcagccgaaaggccctggagctttgtctgaatcgggacattgaactgatgatctttgccggggagcagatcgtactggaccccttctctcagcagtccctctccaagaccttcccctatccggtctttcataacgcggcggtggtatccgaggatcccatcgcctatctggaggagcacgaccttccgctgaccaagatccacggagactggaaccggccggcctacccccttgaggagctctcacagctccagggcgtagaacttacctcctccaacgatcacgactttgaactggtacccgccggagtcaacaaaggccgcactctggccctgctggctctgctgtgggggattcctctggaccagtgcgccgcggtaggcgacagcgaaaacgacttggctatgctccaggcggtaggcatccccatcgccatgggcaacggctgcgaggctgtgaaagcggctgcccgccacgttgcccccgataacgcccacgagggcgtggctcacgccatccgctgggccatggaacagccttaa

SEQ ID NO: 2345 - DNA, 864 bp, Unknown
  Description of Unknown: Ruminococcaceae bacterium D16 sequence
atgaagcgaagccacaaaaaaagactctttggtgcagcggccctggctggggcagcttttctgggaacctgtatttgggcactgcagagcacgcttggggtcagtcaatatgaagttgcgctgccccaggggatggaaggtttggacgggtaccggatcgtccagatcgcggacctgcacagtgcaaagctggatcaggaactggagcaggcactggaacagctccagccccatttgatcgtgatgaccggcgacctggtgaaccgggaggacagggacttttcccaggctctggctacggcggcgctggccgtccgttttgcccccacttactttgtccggggcaaccacgaggtggataatccggactatgccatcctgcgccaggggctggaggaggctggagtcaccattctggaggacgaaggcgtggtgctggagtaccatggtgcgtctttgaatttggtgggggttaaggatgtgaccgcctattcgggaagccggacggaggccatccgcgccatgggacagacagccagcgagcagtttgtggacggggcttaccatgtgctgctctcccaccggcccagcctgctggagacctacgaaacttgtggggcagacctggtgttctccggtcacgcccacggaggacaggtgcgcttgccggtgctgggagcggtgtttgctccggatcaggggctgtggccgcaggtgacggcgggggtccataccgccgggcagacccaggtggtggtcagccggggactgggcaacggaacccctttcccgcgtctgtggaacggtccggagctggtggcggttaccctgcgcgcgcaggagagtttatctcagaatggttga

SEQ ID NO: 2346 - DNA, 996 bp, Unknown
  Description of Unknown: Ruminococcaceae bacterium D16 sequence
atgtttacaaacaggaggggcagagccatgaattttgtggaggaactgaaacagaaagtgctggccggaggtaaggtgacccgggaagaggcgctggagctggtcagtgttcccctggaggcgttaagccaagcggccgatgagttgcgggagcacttctgcggtgaccgctttgacctgtgtaccatcgtcaacggcaagtgcggcaaatgctccgaggactgtaaatactgtgcccagagcgcccactaccacaccagcctggaggagagctatccgcttctctccacagaggaactggtgaaaggggccgcagaaaataagcgccagggcgtattgcgctactccattgtcacctccgggcgtaagctgtccgaccaggaggtagatcaagcctgtgagagcatccgggcgatccgggagcaggtgggtattgaagtatgtgtttccttcggcctgctgggggaggaggcctttcgaaagttgaaagaggcgggggcctccagggtccactgtaatttggagtcctcccggcgttatttcccccaggtgtgtaccacccatacttataacgagaagatcgagacgctgaaagctgctcagcgggcgggactgtccgtctgttccggcggcatcctgggactgggggagacgatggaggaccggatcgacatggtcctcaccgcccgggagttgggagtaaagtccgtgccagtcaatctgctcaaccccattcccggtacaccctatgagcataatccgatcctgaccgaggatgagctgcgccgggtggtagctatcttccgtttcctcattcccgacggcaacattcgtctggcaggaggccgaggcctgctggaggataagggagggcgctgcttccgttccggagccaatgcggctatctcgggcgatatgctgaccaccgcgggcattacggtgcagcgggatcaggagatgctgaaggggctggggtacacggtccgtttggagtaa

SEQ ID NO: 2347 - DNA, 2364 bp, Unknown
  Description of Unknown: Ruminococcaceae bacterium D16 sequence
atgaaacgatattccatgatccacggcctgctggccgccgcactggccgtcaatttggcacttcctgtcaccgccgccgggacctcctcctttaccgatgtcagtgacagcaacaccgccctcaatgccgacattctccggctgatgggcgtggtttccggcaccggaggcaaccagtttaaccccaaccaggtcctcacccgcgcccagttctgcaccatggcggtcaattttatgggtctgggggaccaggtcgtcctccactctacccgcaccattttcaccgatgtgacctccaagcactgggccaggggctatgtaaatctggccgcctccaccatgatcggcggggatgcgggcgcgagcacggacggtgagacccctgtggccggcacgcccctcatctccggcgtgggtgacggccgcttcctccccgacgaccagatctcctatgcccaggcggtgaccattctcatccgggtgctggcctactccagcgataaggttggcgcggtatggcccgatggctacctcaacctggcccagtccatcggcctgaccaagggcctgtctctgcagcccggctcctccctcacccgcgcccaggccgcccagcttctggtcaacgccctcaagtgcaaaaccggagacggcaaggtctactacactaccctgggcgagaccaaggcggataccgtcctgctggccgtcaatgtggccaccgacacgggagacgccatgggcgcggtgcgcacctccaacggtacctatctcccccacatcgaggatgccgcccccaccgcccttcagggcctgcggggcagtctggtactcaacgacaaccaggagatcatcacctttatccccgacgacagcgactcggtcaccatcaccctctccggcgacgcccagcccggctatgtcaagtcgggcaaccagcagtacaccatttcgggcgacaccccggtgtacacccccgacgcccccgagggcaagagctatctggaatgctacacctccctgtattccggcacccagatcaccctgttcacccagcgcggcaaggtggtggccatctacgctaccagcagctccacctcggccagctcggatgctgtggtggttatggaccgggctactgtggctaccttccaccagctcaccggcggcgcgaccagcttcaacatcatcaagaaccgccagaagatcagcctgtccgacatcaagccctacgacgtggtcacctatgacagcctgagcaacacccttgtggtctccgacctgcggatgacctgctactatcaggacgcccaacccacggtggccactcccaagaccatcaacgtcctgggcaatgaatttaccgtcctggagagcgcctggaacaccaccaaggactttaacctgggttccacggtcaccctgctgctcaccgccgacggcaaggtggccggtatggcaaagcccagcgcccaggcccgctccactgcaatcggtatggtcaacgacggcaaggctgtcatcttcctgcctaacggcggcaccatggagctggaaggcacggtgtccaacgcttctgccgagggccagctggtcatcttctccgccggcaagagcagctttaccaccagcagtgcagccgagaaccgggcgcccggccccttcaacgtggataagatgaccttgggcgagtacaccgtcatggccggcgtgcggatctttgaaaaggtcagcagcagcggcgtggtccccatcgatctcagcgatctgtccggctccatcgaggccaagaacatcgccggataccaccgcaacagctcgggcatggtggactatatcatcctcaacgacgtcaccggaaacgcctatgagtacggcatgatggtgggcaaagatatctccaccgatcccgtctatgacgagaacggcgagctgatcagcgaaggctccacccgcacccagtggtcgctggtccgcggtctgggcggcaccatcgaattcagccccgtggcaggctacaacggccgcagcggcgacattgtgggcgtagtcacctacaagaaccgggaagacaaggatatgatccgcaccattgtccagctggagaagttcaccggcgtcaccgccaaggacttcttcgagagccagggcgacctgtatgtgtcggtcaacggccagaattaccgggtggccgacaacgcggagtgctacggcggcatggccggcaaccgcaccgaccccggcagctggttccgccagcccaagctcaccgaccgtgtcaacgccatcaaggccttctccagcaagctcaccgtctatatcgatcccacaggcaagcaggtacgagtcattacggcgggctga

SEQ ID NO: 2348 - DNA, 1872 bp, Unknown
  Description of Unknown: Ruminococcaceae bacterium D16 sequence
atgaagttaaaatccattctcgccgccggcactgccgctgccctgcttgtggggatgctggtactgccggccggcgcccgctccgccacggtccctgcccagcaggaggtaacccaggtagtcaacgcgctgggtattatggtgggcgacagtcagggcaacatgcagctggatcgcaccgtcacccgggccgagtttatcaccatggcggtcaaggcctcccccaacggagaccaggtgggagaggcttccacatccccctaccctgacgtaccctatacccattgggcggctggctttgtagaggccggtgtggccgccgggcttatcaccggatactccgacggcaccttccgcccctccaatcagatcaccctggccgagggtgtgaccattgtcctgcagctgctgggatacagcaacgaggacttttccggcgcctaccccaccccacagatggctctctaccacagcctgaagctggaccgggggctcaaagcccagaacagcagcgacgtgctcacccgctacgacgccatgtatctcttctacaacatgctctccaccaacaccaaatccggcaccccatacatcaattctctgggacactccctcaatgccgccggtgaggtggatctggttgctctgatcaacggcgtgatggacggtcccctggtagccactggcaactggcagtcctccattcccttctccctctcgggcgttaccgtgacccgggacggcgaagcctcttccctgagcaaggtacaggagtacgatgtggtctactggtgccagtccatgcgcaccctgtgggtctactcggacaaggtggtgggcaccattcaggccatcacccccaacaccgctgctcccactgcagtgaccatcggcggacactcctatgagctggacagcgcggctgccgtctatgctctgtccgatctgggcacctatgacctgggtgacacagtctctctgctcctcggccgtcagggcaaggtagccgctgtcaccgaccccattgccaccacctcagagcgctgcggtgtggtcaccaaggtcacccgggagtcttactccgacggttaccactcctcctataccgccgataccattacccttctggctaccgacggcaactcttacaactatgagtgcaccacccacacctacgaggtaggcgatctggtaggagtgaacattgccgcagacggcaccgtctccctcaagcgtctgcaggctgcaaagctctccggcaaggtcagcagcgacggcagcaaaatcggctccacccctctggctgacggcgtggaaattctggacgtatacgagaactccggaacccgggtctttgccagccgcctggccggcatcaatctcacccaggatatggtcagctactacaccatgaacggcagcggtgagatcgaccgtctgattctgaacgatgttaccggcgataactacagctacggcctgctgacccggatggatgtactcccctccggcggcctgatcaactattacacctatgtgtatgatgtgggcggcaccacctacaccctgcccaacatcaccaccggcttccccgtcagcaccggcggtgtgatgatcaagggcgaccttaccaaccccgacaagatctacaacctcaccaaggtgactgccaccagcatcagcggaaatcagctcatcgccagcaaccgctcttacaccatggcagacaacgtggtggtctacgaataccgcaacggctcctactacctctcctccgctcagcgggtccaggagaagggactgagcctcaccggttggtacgacaaggcagaaagcaacggcggacgcatccgcattgtggttgcaaaataa

SEQ ID NO: 2349 - DNA, 1659 bp, Unknown
  Description of Unknown: Ruminococcaceae bacterium D16 sequence
atgaagatacggcggcccagaatggatattgaaaacaagatcctgatcccctttgtgtgcatcagtctggctaccgtgatctgcttttgcgccatcttgtattttacggaataccgggtcaaggtagctgccgagcgggagaatgccagtaccctgattgggtatatccaggccgatttggaactggaggattaccgccaggacccgaaaaagctgctggctaagtaccgcaatcactacacgggagacagcctgtttatctatgatgagcagggagagcttctgctgggaaagcccggtgtggatgctgaggacctggaggtactggcccaggccaccgatccccagctgggctgggagatctcataccgcctggataacagtgccctgcaggagcggttcattgaggaacagaaatatatgatcctggcggcggtggccatgctggtgatcattgtccaggccagcgtactcattgctcacaacatctctgaccccatccgccgtctcggtgaggtctgccagagcgtcagcgagagtccggaacaggaagaactggatatggaggagtatctgggcaaggcggacgaggtgggccagctggcccgggcctttgcccggatgatggagagcatccgaacctataccggagaactgattcgggtcaaaaccctgaatgagagtatcgtggaaaacctgcccttcggcgtggtggcttacgaccaggaaggaaaggccttttgtgtcaatgccagcgcctcggccatgttgggacggcaggaggagcgggacgagcagggccgtaccctggagatgctgctgggacagatcatgcgccgggaagacgtgctgcccgaccccgcccatctgacggagcccacgggaaaaagccgggactacgaatttggcgtatggcagctgcgggagccggacggctcccggtggggcgtgctgtgtaccatcgacgacgtcacttataaaaagagaatggaggagcgctccagcgaggaggaaaagctggcctacactggcaagctggccgccgatgtggcccatgagatccgcaaccctctggcgggtattcgggcaggcatccaggtggtcagccgcaagctgactcaggagcgggatcagaagctgtgtgagggcatggtgcgggaggtagaccgggtcaacctgctcatcgagaaccttctgaacctgtcccggcggcgggagagccaaaagaccacggtaagcctcaacgcgctgtttgatgagctgcagctgctgtactttaaggtggcggaaaataagggcatcgcctttaccgcccaggtggagggcagcctgtggctgtacgcagacgagggggaactgcgccaggtactgatcaacctgatcaacaacgcggtaaaggccatgccggacggcgggcagctggagatccgggcggaaaaggagccggagggtgtgtgcctgacggtgaccgataccggcgtaggtatgggaccggagaaattggagcaggtgctgcatggggccgggaccggcggccttggcctgtccattgtgcggcggctcctgggagaaaacggaggacagctctccatggagagcgggcgtggggaaggtacccgggcacggattgcctttcctggcaaaggaggagaagcatga

SEQ ID NO: 2350 - DNA, 2016 bp, Unknown
  Description of Unknown: Ruminococcaceae bacterium D16 sequence
atggagttggcggatcagaagaaaaaaagaaggcttctccacctgtccaagacaggcaggcggcggcttcttgtgcccacggcctttttcctggccgttatttattatgaagagctgtttatgaagctcttctgctttcatagcctgtccccggccggggcattttttaccctgctgttctccattccggtggcggtgctgctgggactgctgtgcggcggcgtgcaggagcggcggggacggtggctggtagtgatatgtaccgccctgctctccctgtggatgggctctcagatcgtctactaccatctgttcaaaacctttttgaccatcttttccatcaccaaaatggccatggtggccggagccttcggcgatatggcggtgggccagatcctgatgaactggtttcccattttgatgatggtggtgcctgtggtgctgtccctggtgttccgggaccggatcgtgagtggcgagcctctggcccggggcgaccgactgcgctggtttggcgtgggtgcgctggtacaggtggcggggatcctcttggtgctgctgtgcggcggggggaacctgtcgctgcggtatatctacttccaggcggccgcgccggagctggaggtacagaacttcggtatgatcacccagacccaactggagatccggcgggtgctctttgggatcgatccggacgaccagatcctgcccaagctggcggtgcgcacttccgcaccctaccagctggaggagaagaaggagccaggactgcatgtgatggagatcgactttgacgctctgctggagcgggaccgggacgatccggtgcttaccgacatgcaccagtacttctccaaagtggaacctacggcggaaaatgaatggacgggccgctttgcaggaaaaaatctggtctgggtggtggcagaaggattttccaccctggctatggatccccagcgtactcccaccttgtggaagctgtcccatgagggaattatctgcgaccacttctatacgcccttgtggggggtgtccacctcggacggggagtatgtgaccaccacgggtctcatccccaagtcgggggtgtggagttactcggagtcgtcggacaactacatgcccttcggctttggcaccctgttcaagaacctgggataccgcaccctggcctaccacgactatctctacgattactacgaccgcaacctctctcatcccaatatgggctacgaatattacggcatcggcaacggactggatatggagatcgacgaggagaatttcccgccctctgaccaggagatgatggaaaagatcgtgccccaatttgtgaatgaggatcagttcatggtctactgcctgacggtgagcggccatttgaagtacaactatgagagcaactccatggcccgccgccactggagccaggtgtcggacctgggctactccgaggcggtgaccgcctatctggcctgccagatggagctggagctggccatggagagcctggtcaatcagctggaggaggcaggcaagctggatgacaccgttatcgtcctctctgccgaccactacccctatggccttaccgatgaggagtacagcgaactgctgggccacgaggtggaccccgtctttgaaatctacaaaaacaccttgattttgtggagtgcagatatcaaagaacctgtccatgtggataaattctgttccagcctggatgtgatgcccaccctggccaatctctttggcctggaatacgactcccggctcattatggggcgggacattctctcggatgagcccgggctggtcatcttctccaattacagctttatcaccgacaagggacgctatgactccaccaccgacaccttccaaatgtgggacggcagcgagcctgacccggagtatgtggcggagcgcctctccgaggtgcaaaaccgggtggcctactcggcgtctattttggataacgactattaccgggtggtatttggagcttcctga

SEQ ID NO: 2351 - DNA, 1305 bp, Unknown
  Description of Unknown: Firmicutes bacterium sequence
atgacaaaaaaatacgtaagcggcgggatcgacgaacttatcgattgttcggcagcttacgacaacgttaatagtaaattcggcgaggaataccttagatggtgttccttgccttttgatacgccggatttgtccgatttgataacatacggcatgcaggtgcgagaaaatgtcgaatacttggttgttttaggcataggcggttcttctctcggattgagcatggttgcaaatgcaactttgcacttaagacataacgagttaaacagatttgccagaaaagctccgaaattgtatgtagtgtccaatacggatcccgatgaaatgagcaatttgttcgacgtaatagatttgcgaaaaacgcatttttgcgtagttacgaaaagcggcgacacgggagagacgctcgccaatttttatgtttgttacgacaaattaaaaagagtagtcggagacgacgccaagggtaaagtttgtgccgtaaccactataggcaaagggactttgtatgattttgccgtaagagaaggaataaggattttcgggattgataagggcgtgggcggtcgattttccgtgctcagcaatgccggactcgtgcctatgagtatattagggatagacataagaaatttgttatacggagcaagaagagccacgtgtggctgtatacaaaaaaatatttataaaaatcctgcgcttataacggcgtctttgcttgtcttgtcaaagaaaaaaggttataatatctgtgtacttatgccgtattcggacaggcttagattgcttcctgacttttttgctcagctttgggcagagtctttaggaaaaaggactacaaaaagcggcgctacggtcaacgaaggtcaaacgccgttaaaagcgttgggcagcgtggatcagcattcgcttttgcaactgttggtggaaggtccacaggataaggtcgttattttcgtcggagtgagggataggctgaaaggctttgccgtttcgcagtcgcatgacggatatcttaatgggaaagaactcggggatattctggatgcgtccatgcgagggaccgcaatgtcgctagtaaatgcgggcagacccaatatgactataaccgtagatgagattaacgaagagagtgttggcgaactactgacattttttatgtttgctacggcatatgccggcgagcttctgagcgtggatgcttttaatcaacccggcgtggagtacggcaaaagtatgactcgcaagctgcttggcgaaaatatgcgagaagtatcagacaaaaactttattgtgaggttatga

SEQ ID NO: 2352 - DNA, 918 bp, Unknown
  Description of Unknown: Firmicutes bacterium sequence
atgacaaatataatttgggcagacataaagaaaatagctgccagaagtcagacggctttggtcgcaaattcggaatttaactttaacagacaaattttcgatatagcaaccgacatatataacgatgacgacgataggttgatatttatagcaggaccgtcggcgagcggaaaaaccacttctgccaatttgttggcgttaagactggaatacttcggtatcaaagtgttcagattgtctaccgacgattattttatcgatagggacaaagtgccgtttttggaaaacggattgagagattttgacagccttcgcagcgtaaatgtggaaaaactgcaagaggacgtaagggcaataatgcagggtaaaccgtttgagccgctcagatacgattttatttccggcaaatctcttaaggacgagcctgtcgttgcgcacaaggaagacgtagttatattagaagggatacatgcccttaatccggttattactcaactttccggttatgacgaaagccggatgaaagaggcgtctatagcccctcgaagaagttttgttatgaatagcggagccgttctttcgccggacgagctaagattgaccaggcgattaatacgagattattatacgagagggtacgactttaagacaacgctggagcaatggcaggaagtgagagctgcagagaccaagtttattttaccgtatatgcaagacgttgactacgagattgacagcacatacgattacgaattgatggtgtacaaaggctgtatatatgacgctataaagcattcgactctaccgcaacttcagaatataatcaaagtgctcggcgaagtagacgaaatgaatatttcttctatacccgaaaattcgttgcttaacgagtttgcacatttcggtaagcgtaattag

SEQ ID NO: 2353 - DNA, 1059 bp, Unknown
  Description of Unknown: Firmicutes bacterium sequence
atggcagacgaaatcgttaaaggaatgaaagcgtccgagccggaaaaaggcgttgtggattacgttaccgatgataacgtggttttggacgtaagacatttaaaaaaatatttcccgatagctacaaactttttcggtaaacccaccaggttccttaaggcagttgacgatgtatcgtttaaggtaaccagaggcaaaacgctcggtatagtaggcgaatccggttgcggaaaaaccactatgggcagatgtattcttagattgcacgagataactgcaggcgacgtattcttcggagattacaatattcgtactctctcgaataaagaaatgcaaaaaattcgtccgcagattcagatgatattccaggatccgtattcttcgctgtcgccccgtttgccggtcggcgaaataataggtgaagcggttaaggctcatcatctcgtggataaagcaaattacaaagattacatcttggacgtaatgaagaagtgcggcttgcagactcattattacgaacgttatccgcacgaattttccggcggacagcgtcaacgtatttgtatagcgagagcgctggctttgcagcctaagcttgtcgtttgcgacgaacctgtttcggcgttggacgtttctatacaggctcagataattaaccttctcaaagatcttcaggacgaacttaatttgacttacgtgttcatatcccacgacttgtccgttgtagaacatatctcggacgaaatcggcgttatgtacctcggcagtatggttgagagcggtgacaagagcaagatatacgcaaatcccatgcatccctatacgcaggctttgctttcggcagtacccgttcccgatcccaacgttaagatgaatcgtattattcttaagggagatattccttctccggcgaatccgcctaagggatgtaagttccatactcgttgtcacaagtgcatggatatatgtaagaaggttgcacccaaatttaatgagtacgagcctaatcacttctgtgcttgccatctttacgatcagggcgttatggaaagcaaataa

SEQ ID NO: 2354 - DNA, 432 bp, Unknown
  Description of Unknown: Firmicutes bacterium sequence
gctctttttaggaacttacccttattaatattagttatgactaaagatacaaacgcttcgaggctcgagcgcatatcggcattaaaagcgattttgtataaaatgccaaacagaggaggaaatatggtagtagcaaccccgtataattacggcgatatagcgaccgattttaattatgcagaacagtttaaactatacaaaatcaaggacggaagcatagtaactacggatttggtacttaccaacggcagcgggtattttccgcttatatcgttattatcgaggctaaacgtaaacgtgcttgtttgcgggacgcttaaggctgcggcaaaaaaaatgctggacgagttcaatataaagtatgtttgcggaaacagcggagactctgataaagctgtagaatcttacatagccgctttaaacggcatttag

SEQ ID NO: 2355 - DNA, 630 bp, Unknown
  Description of Unknown: Firmicutes bacterium sequence
atgaatggcaaattgaaaaagaagataaaagttattttctgcctgctttgcactttgcttttaattatttttcacataaaaaccaacgtaaatcccgttttaatcgtactatttgaagaacaagtaaaaactttagccaacatagcggttaataacgcttgcgacagcgtagtaagctcatacgacttgaatttaatgataaattacaagtacaatgcaaacggaaaattagaagttatcaacgtaaactcggctttagcaaacaaaataagtaaagaaattatgcttaaaagcgaatataacatttcagacttgggcaaaaacggagtttcggtaccgataggagcgttgagcggcatcacataccttagcggaaaaggaccgattctaaaagtcaatgcctgtccttcaggctctataggcgtttattttaattccgattttcaatccgtgggaataaatcatacaaagcacagcatatacctcgtcgtaaactcttcgataagcattgtagttcccggattaaaccattcaatcagaacttcaacaactgtattgctttgcgaaaatttaattataggtgaggttccggacggaataatctacggaaattcattttctcagccctaa

SEQ ID NO: 2356 - DNA, 948 bp, Unknown
  Description of Unknown: Firmicutes bacterium sequence
gccttgttttttttacatataaatgctccggctgttagaaataatatcataacgattagaacccgcacaaaaaataagttttgcgcagtagttaaagccaatgcctacggacacggtctggagctttgcaaatatatagacgatttggtcgattgctatgccgtagcatggagctgcgaagccgaagcgctttgtaactacacgagcaaagatatatacgttttaaacagcgactatgatatcggtaaaaaaaatataatttattccgccgcaaccaaaaaagatttacttcataaacgtatttgtgttaaaataaatactggaatgaatcgtaacggcatttacccacaagagttcaacgattttattgcccgtagaccgttatatactgagatagaaagtgtctatactcatttttgctcggtggaatatgcaaaaaaacaattcgaagcttttgacacgctgaatttcccggttaagcattgttgcgcaagcaattgtatggttttgccgacaaaatattttaaggacatggtcagagtcggattggcaatgtacggatacgattattcattgtctccgtgtatgagcgttaaagctgcaatatcggcggttcttagcgtaaaaaagggcgaacatatcggctatggcaattttttagctcccgttgacatgaaaatcgcagtattggaggctggctacgccgacggtttgcgcagatgtgaaaattttttcgaagtgggcgggaccgtttgtaaaaccgtaggctcgatttgtatggatgtttgcatggttgatgttagcgagtgcgaatttgtgccaaagcaggcgatttttattggagacagactaaaaatcgatgatgttgcaaaaagatacggcacgattccgtacgaagtattaactgcttttaacggaagaaataggaggatgtatgcgacagattga

SEQ ID NO: 2357 - DNA, 732 bp, Unknown
  Description of Unknown: Firmicutes bacterium sequence
atgtcaaaaggtgcagtcagacgcttgattatcgagggctcggagatagaatacgagcttattcgtaagcgtataaggaacatttatttcagcgtaaaagggggcggtaaagtgctggtgtcggcacctgcatccgtccctatttgttatgtcgaaaaagctttgatgaacaggtggccaaatattcgcaaagcgttggattcgcagagtaatataccacctttgtggatattgtccgagcaacaaaaatccgtatgcgtatatgggaaagtcagacaagtgcaggttgtaaagagtagcaacggtatttcattggacaacgagtcgatgacggttttttgcaaagacgaaaatgatttgaagtccataaaaaaggtatataccgaaaagataaaagaaaattttaaaaacgttgttttaaagttttgcgagcgtacgtatgcgacttttggcgacagaatagaaaacttccccactataaaattcagagaaatgacttcgaggtggggaagttgcaaaaagtccgactgcgttataacgatagcatacggattggcaatagcgccgtcggagtgtatagagtacgttattgcacacgagtttgcgcatttgataagcccggatcattcgcctcgattttatgccgtacttgattccgtaatgccggatcaccgaagccgtcgtaagaatctaaaaaaatataaacttcttaagtccgattcgtattcgtaa

SEQ ID NO: 2358 - DNA, 1104 bp, Unknown
  Description of Unknown: Firmicutes bacterium sequence
atgaaaaagagaaagataacgtacgaccttacggctcgtcaaaaaaaggaacttaagcgttcttccggagctaacggctcagtaacacccaaggagcctactgccgaagagattgctcttaaggaaagcagagtaagcgcaagaaaacttattcttgtaatcaccgctacggtcttggcggttgtgtttgttctcagcggtgcgcttatacccgtggtgcagtctaacaaagagtacagtaagcttacaaacgactattttcttgactggaaaactgaggagggcgaaactctcacaaatcctaccgctaccattcatcttgtggacggcgacggtaaaaatttcggagatattaagctcgagttgtttatggatgcggctccgaatgcatgtattaactttatttaccttgcggaaagcggattctttgacaatactattttccacgataaaactcagggtttgatttggtttggtggatacaaacttaacgccgagtacgactctaacgacgaaaattcggcaaaatacgtgtctaaagccaacgatgagaagttcttgtccaaacttaccggattcacgaagcataatggtaacgtagtcgatggcgacgacgttgacagcgctaatcgtaagtacaagctcggttatcgtttcactgccgaaacgaccaagaagaactctggcaaccagtacggaatgcttatgatgcaggcaggtacgggcagcgagtattctacttctacgcactttatgttttcgacagacacgtctccgtcgtttaccaagtggaataacggttccaatatgggtagttacgtttcttacgttgcaaaaattgcaaatgacgatgaaggaaagtctttcgatactctcgacaaaataaacgctctcgctaccgtgggtaaggaaaacggcaaagaaaacaatgctaagcagatatattatcaatatatcgatgtcagtcttgtaaaaatcgctagtattgaaacttcgctttctaaagctcaaagaaagtatattcttaagaattttgaaagctttgttacgtccggcacctggagagctaacgcttataatcccgaatattttaaatttaactga

SEQ ID NO: 2359 - DNA, 561 bp, Unknown
  Description of Unknown: Firmicutes bacterium sequence
atgatagaagcaggagatttcagaaaaggcgttaccgtggaaatagatggaaaagtttatattattgtagactttcagcacgttaagccgggcaagggcgcagcgttcgtcagagcaaagattaagaacgtagtaaccggacaagtattggagcagacgtttaacccgtccgataagtatcctttggctcatatcgagcgcaaagatatgcaatattcgtataatgacggcgatctttactacttcctggatatggagtcatacgaaatgattccgctcaattacgacgtttgcgcagaagcgcttaagtacatcaaggaagaaatgatggcttcggtacagttctataagggtgcggctttcagtgtagaagctcctaacttcgtagaacttgtcgtagcggaaaccgaaccgggtgttcagggcgatacgtctaaagccggaaataagccggctaagctcgagaccggtacggcaattcaggttcctttatttgtaaaccagggcgagaaaatcagagttgatactcgtaccggaacatatatggaaagagtaaaataa

SEQ ID NO: 2360 - DNA, 828 bp, Unknown
  Description of Unknown: Firmicutes bacterium sequence
atgaaaacaaaagaagatatagatattcttataaacagagagataagtagggcgggatttgacgtaaaacttttggaaattataaactacgttttttctaccgggggcaagagacttaggcctttgatgtttttggaaacatattcgttaagcggaaacgatgcaaacgaagctgtggaaaaatttgcagttgcgatagagtgcctccatcagtatactttggttcatgacgatttgccgtgcatggataatgactcaatcaggcgaggtatgccttcgtgtcatgctaagtacggagaaacgtttgctctgcttgcgggagacgcattactgaactacgcttatacgctgattttggatgcgataaaaatttccggttatgataaaaattttgtaaatgccgcatacgcattttcggtgcttagcggaggctccggtgtgataggcggacagttcttggaatttgcgtcgacgtcgcctctgtcggacgtgtttgatgtgtatagacgtaagacttgttaccttatgtggggggcggtatatgccggcgcagttatcgcaaagctgccgcaaaatacgataaaccgattaaacgagtatgtttacaattacggtttttgttttcaaatttgcgatgatttcgccgatataaaagaaaagggcgaagtatcgtcgcagtctattgtttcgctctatggacctgaaaaatcgaaaaaaatggctatcgaagctgcagataatgccaaaaaatcacttgttatgtctggcataaacagtgattttttcacgggtttgatagataaattggtaggtatattggttgactga

SEQ ID NO: 2361 - DNA, 711 bp, Unknown
  Description of Unknown: Firmicutes bacterium sequence
acccacacttccggattcaaaaattatactttcagagacctaacggaagacatgccgcttataaaaaagcattggatttccgagggcattacttttgatgcgatatacacaggttacctcggcagcgcaaaacaaatagactatgttaaagactttataaaggaaaccctcaatccgggcggcattaccgttatcgatcccgccatggcagactgcggcaaactttatccggggtgcgatctcgatttcgtgcaaaagatgaaatctctgtgcgaaaacgctgactaccttgtcccaaacataacggaagcatgtctgcttacagggataccgtattgcgaaaattacgacgaaagttatataaccgaaatttgtgcggcacttgcctcgctcggcgcaaaaaccatagttttgaccggagtaagctacgatccgtcatttaccggagtagtcgtttatgacggaaagatacgatattataaacataaacgaataaacagaggttgccacggcaccggcgacgtatacgcatctgcatttacgggagctttgcttaacggcataaatcctttcgacgctgctcgaatcgctgctaactacaccgttcgttgtatcgaaaacacaattaccgacacaacacactggtacggagtaaaatttgaaacggctttatcctcccttatcgaagaaataaaatcggaaggcaagtaa

SEQ ID NO: 2362 - DNA, 831 bp, Unknown
  Description of Unknown: Firmicutes bacterium sequence
atgctttctgcgcttgtccacaccgccggggcgttatcgttcggaagagagggaataggtgctgagattatcagcgaaacgccgtgcgtagtaagcgtagccgcacttttgacaaaacgtctttatgacgccgaatgtgagttttctcacaatcagttgtcgctaaaaggcggatacgtattagagatgttgttcgatttgggcattctcacttacgaaggagaaggcgtcggcgcatatccggggataagcggattcgtagtggcggaggattgctgtttgcggagttatcttcgaggcgtatttttgggttgcggaagtctttctataggtaaaaaatatcatttggaaatgagtttttccacgcttgtaatggcgcaggacgtgatagcacttttgggcagtttcgacattacggctaaggttttggctcggcacgaaaaacatgtcgtttatataaagggcagcgaatctatttgcgattttttggcgttgatcggagcctcaaaagccgttttggcgataagcgagcttgtcgcaaaccgaatagcgtccagtcaagccaacaggtgtactaattgcgatctggcaaatgcggacaagactgtcgccacgagcatgaaacagattgagtgtataaaaaaggtggcggattatgttaccgatcctaagctcacgactgttatgaatgtaaggctaaacatgccggaatccagctacgaagaacttgcgtccgagttgggcgtaagtaaaagtactataaaatacagattaaagaagttagaaaaaatggcaaacgatatgccgaaatcgacgacggaggacaaataa

SEQ ID NO: 2363 - DNA, 660 bp, Unknown
  Description of Unknown: Firmicutes bacterium sequence
atggacaaaatcagtgaaatcgaaaaaataataggctatagctttaaggacaaagacttgcttgcgactgcgtttacgcattcttcttatgcctatcaatacaaaacgaaaagcaatgaaaatttagagtttttgggagacagtattcttaattttatcgttgcggagctgctgtacctttcatctatcggagatgaaggtcaaatgacggaagtcagggcggcagtagtgtcgagagatccgcttgccgcagttatacgcaaaagcggattaaaagcgtatataagatacggcaccggatgcgagtcgcagcatcattcggtaaaattcgacagcaatttgtttgaagctattttgggtgcgatttacattgacggcggcatggataatgcgaagcatttcgtgtataataatttaggaaaaaacataagctacgcagacaaatacgattacaaatctcgacttcaggaatacaagcaagcaaattgtaacgagtccgagttaaagtacgtcactcatgcgcatggcagcggttttatgtctactgtgtatatcggcgacgatagactcggcgtcggcagcggcagaaaaaagaaagaagccgaaagagaggctgcgaaaatggcgttgaattcacttggcgttcttattaattactaa

SEQ ID NO: 2364 - DNA, 780 bp, Unknown
  Description of Unknown: Firmicutes bacterium sequence
atgaaaagaaataagcttttaacacaaaaaagaaagcgtccgttcttcggattattcaaagctatcgtaaaactgtttacgaaaaagcctaaacttatcgtaaaaggtcagcctcttgacgacggatgtctgctgctcggtaatcacgccaacaaaaacggtccactaatgtacgacgtctatctgcctctttatacatgcaaatggggcgcatatcaaatgttgtgcggatacaaagatagatttctctatctaagaaacgtcctttatatccaaaagaacggctacggaaagtttgcggcaacaataaaagcgctcttcgaagcatgtttttcgaaatttatatacaaaggactaaacattttgccttcgtacccggatacccggctgctcggcaccgtaaaaagctcggtagaggcccttaaaaacgatgtttccgtaatgatttatcccgaggactcgtccaaaggataccacgatgtaattacttcgtttttatcgggatttactttggtaatgagtcaatacaaaaaagaaacaggaaaagacgttgcagtacgccccgcatactatcataagaaaaaatctcttataatagtcggcgaaaagtattattacgacgaacttacgaaacaaggaatttcaaaaagagagtttccggagtttttcaagaataaagtcaacgaactttacgcttacgcagaaagggaaataacggctaaacggaacaaaaagcaaaacaaccgttttgccggcgataaagtaagcacaaaagtttaa

SEQ ID NO: 2365 - DNA, 711 bp, Unknown
  Description of Unknown: Firmicutes bacterium sequence
atggaattggaaaatttggaagaagtgctggaatcgttgttttttgtttccggcaacggcttaaaagtctcggaagttgccgatcttttagaagtccaaaagccggagataaacaaagcgattaaaaaattaaaggaaaaatattcgggtaagaacggcatacatcttatcgaatacaatggtaaggtgcagttttcgtctaatcccgcttacgcagatgccgtggctaaagttcttaatccgattaaagagaaagaactgtcttccgcaacactggaaacagtggctataatagcgtacaagcaaccggttactaggctggaacttgaagaaattcgcggtgttaattgcgattatgttattcaagtgctgctcaaacataaccttatcgaagtagtcggaagaaaagatgcggtaggtaaaccgctgcttttcggcactacagacgagttcttgaaacgctttcaaatttcttcgatacaggatttgcccgattacgagcaacttctcgacagcattaaggtaatatcgggagacggcgattctaagggattgtataacgaatttgaaattcccgacgaggaagttcccgaatttttgcagggagagcaattgcagaagatagaagcgccgttgcccctcgaagaagtcgcagcagcagcgcagagcgacgaagaaaacaatgcaaaagaggatacttctgaagaataa

SEQ ID NO: 2366 - DNA, 486 bp, Unknown
  Description of Unknown: Firmicutes bacterium sequence
gtgtgtttgcacaaactacattataccttatttggcgtcatattgcaatcaaataaaggtatatatttgattttttttgcggcacgatattattttgttgcactttgcgaaaaactatttacgatgaaggaaaggatgaaaaaaattttgggttggataggcggcggagtcgtggggttcgtaagcggatttttcggcggtggcggcggaatgatatgcgtgccgcttttgcaaaaaggcatgcgacaaaacgccaaggtggctcacgcaactgctatgcctgttattttgccggtttcggtattttcggcgataacttatgcaatcgaaggcttttttaattttcctgctactctctggacgggaatcggtgcggtagtaggcggaattataggcgcattgctgctcaaaaaactcgaatcgggagcggtcagaataatttttgcggtaattatgcttgcggcaggagtgaagatgatattatga

SEQ ID NO: 2367 - DNA, 717 bp, Unknown
  Description of Unknown: Firmicutes bacterium sequence
atgacggaaattacttcttcggacaacaaaataattaagcacgccgctgctttaaaagaaaaaaaataccgcgacttatatggcgaatacttggttgaaggattgcgaggcgtatccgatacgcctcgtgatgttttgcgatcaattttttgcactaagcaaaacgcagaagcgcttaaagattatcggtgcgatgtttatatcgttaccgaaaaaataatgaaaaaactttcggataccgataatttcagcggaatcgtagcggttgccgcaaaagcggaatttccggagtttaacggcgattacgttgtatatctcgataggataagagacccgggaaatatgggcgccataattcggactgccgttgcggcaggctacgaagtcgtttgtgacggttgcgtagacgtatataacgcaaaggtagtaaggtcgtgcgtctctgcgcttagtaaagtacgccttcatgtaggtaattttattgacattttacgacaaaaagggtacaatattattggtgcggatattcgcggtaaaaacatgttttcgtcgcaaaaacccggaaaagtgtgtctggttataggcaacgaggctaacggaatttgcgacgagattattgcaaactgcgatatgctttgccgcatccccatgcaaaacatggagtctttgaatgctgcggtaagcgcaggcattcttatgtattactttaaatattga

SEQ ID NO: 2368 - DNA, 513 bp, Unknown
  Description of Unknown: Firmicutes bacterium sequence
atgccaaacattaaatctgcaaaaaagcgcgtattagttaacgctaccaaaaacgaaagaaatactcagcttaccagcgagtatcgtaccgctataaagaaattccgcaccgctatcgaaaccaacaacatcgaacttgccgagaagttacttcccgaaacactttcgatcatcgacggcgctgcgaccaaaggcatcatcacaaagagctgtgcggacaaccataagtccaaactttccaaaagcctttcggacgttaagagcggtaaaaaagtcatcgttgtaaagaaggacaacaagaccatcgcagccgaaaagcgtgccgagaagatagctaaagaagaagcagctctcgaagccgcaagaaaggaagccgaagaaaaagcagcggctaaaaaagcagtagccgaagaagctcccaaaaaggcaaccaaaaaagccgataaaaaggaagataagaaagaagctcccaaaaaggcaaccaaaaagtctgcaaaaaaggaagataagtaa

SEQ ID NO: 2369 - DNA, 576 bp, Unknown
  Description of Unknown: Firmicutes bacterium sequence
atgaattattttgaagagggcgaaaagatattaaaaagcggcaagaagcgaatactactgcacagctgttgcgctccgtgcagtagcagtgttttgtggtatcttatgccgctgagttatgtgacggtttttttctacaatccaaacgtaatgccttattccgagtatgccaaaagacttaccgaacagcggagactatgttcgattatgggagtaaacttggtcgaaggcgattacgatgcggaacgttttttgagctttgcctgcgacatgaggtacattcccgaaggtgggaaaagatgcgaaaaatgtttttatatgcggcttaaggcgactgctgaaatggcgcaggaaggcgattacgattatttttgtacaactctcacggtttcaccgcacaaaaacgcagataagattaacgaaataggtaatgctgtcgcaaaagagacggggatttcttttttgccgtccgattttaagaaaaaagacggataccttcgttctattaagctaagcaaagaatacgagttgtacagacaggagtattgcggatgccggttacaagacaaaatttag

SEQ ID NO: 2370 - DNA, 408 bp, Unknown
  Description of Unknown: Firmicutes bacterium sequence
atgaataagtgtgtgttggtaggcaatctcaccagagaacccgaacattcgtctaccgctaacggcgtggcgttttgtaggtttagcatagcggttaatcgcaactatgctaacagcaacggcgaaagagaggcggattttataaatatcgttacttggagaggacttgcggacaattgcgttaagtatcttaccaagggtagcaaggtagccgtttcaggttcgatacagactcgcacgtacgaaaaagacggcgtaaagagaactgcaaccgagattgtcgctgacgacgtagagtttctctcgcctaagagttcggacggacaggcaacatccgttcgcagttccggcgcaaagtcctcgggtatggaactcgagccggtagaagattccgagttgccgttttaa

SEQ ID NO: 2371 - DNA, 225 bp, Unknown
  Description of Unknown: Firmicutes bacterium sequence
atgcctaagggtgataatatcgaagctgaaggtactgtagtagagtgcttgcgtaacgcaatgttcaaggttaagttaaataacggcggacacatagttacatgcacgatatccggtaaaatccgtatgcactacattaaggttctcgaaggcgacaccgtaaaaatcgaaatgtcgccgtacgatattactaaaggtcgtataacgtaccgtaacaaaaactaa

SEQ ID NO: 2372 - DNA, 831 bp, Unknown
  Description of Unknown: Firmicutes bacterium sequence
atgaaaaaaaaggtaggcgtaaatgtgtatgctaaaataaattttacgttaaacgtaggtaaaaaaacggggaatttgcacgaaatagattccctggtttcctcgataaacgtttatgacactatatttgtaagcgacagattggacggtaaaataaaccttgctttcgattcggacgtgttcgttgcaccgcaggaaaatacggtaataaaagccataaaggcgcttagagatgatttcggagatttcggcgttgacgtgaccgtaaaaaagaatatcccgttttgcgccgggatgggtggctcatcggcagacgcagccggcgtcatagctgcgctaagcgaactgttcgattttgaaaagcgctatataaattatgctaaagtttgcaaaaaaacgggttccgacgttttgtatatgctaagcggcggatacgcacgaatatccggaacgggagaaaaggtggaaaaacttccttacgacggtacttttaccggagttgccgttacttcgaagggagtggaaacaaaagacgtatacaagaagtttgacgaggtgggcggcgatttgcctacggataacaactcgggcttttcgcagaatatgagacttgggaacatgcttatgaaagcggcttgcgaaattaatccgcaaatctgcgcttgtgcagccgcgttggagagggagggacttacccctaacatgaccggcagcggctctacggtatatgcgtttactcaagacgcacgagaaatagcgaaaaaacttacggcaaaaggtttgcgcacatttgcatttgaaactttaccttacggaatagaatttttgtaa

SEQ ID NO: 2373 - DNA, 1254 bp, Unknown
  Description of Unknown: Firmicutes bacterium sequence
cggggagttaaaatgaaagctgtggttttttcactcggatgtaaagtgaatacttacgaaggacaagcgataatatcctttctcgaagcgaacggcatacaagccaccgacaagccatgttacgccgacgcttatattataaacacttgttcggttacggcggaggcggacaaaaagtcaaggcaggcggtcgagcgaatgcgcaagtataacagaaacgcaagaattttggttatcggttgcagctcccaaaacgacggttccgcatatcggcaaaaaaacgtcagtttaagcggagtcggcggcaaaatacaatctgtagccgaatttttgcagctcgacgttgataaaaacggcgattttaccgtggatttgccgcttacttacgaagaaatgaatattcctaaacctactcgtacgagggggtacataaagattcaggacggctgcaataacttttgttcgtattgccgaataccgtacctaaggggcagatcgaggtccagaaaaatagaatcgatagttgaggaagcgaaaacggcggctctccatagtaaagagatagtgcttacgggcataaatatctccgattacagagacggagagaacggtttgccagagcttgtttatgcattgaaagacgtttgcgctcgaaaacgattcggttcgctcgagtgcgaagttatagatgacaaattgctttcggcaatgaaagaatgcggtttttgcgatcattttcatttgtctctccagagtggttcggatgccgtgcttaaaagaatgaacaggcgatataccgctcgattttatcaggagaaatgcgagtcggtgcgcaagtatttccctgccgccgccattacgaccgatataataacggggttcccgttagagagcgaaagtgaattcgaagagacttgcgaattcgtagaaaagattaagtttgcggcgttgcatgcttttccgtactcggagcgcaaaggtacggcggcgtattcgatgccacaaatcgacaagcgtatacgaagcgaaagagcaggtaaacttataggaataggtaaaaaacttgcagacgagtttatccgcagccatataggctcgatagccgaagtttatgcggaggaaagtaaagacggaatttcggaaggatatacttccaattatataaaagtttattcgtcgcttaagccgggagagcttgctaaagtgaaactcaccgaggttatggcagacggagcaaaaggagaaatagtatga

SEQ ID NO: 2374 - DNA, 1245 bp, Unknown
  Description of Unknown: Firmicutes bacterium sequence
atggaccagatagacaaggtgttaaagaacaaagttatagaagcgtcgggttgtaccgagcctatagcggtagcgtacgcatgtgctaatgcggcgaaacttatcaaatcccgacctacgtccgtagagctcgagctttctgcaaacgtcataaaaaacgctatgatagtgtgcttgccgggaacgcatggcaaatacggaataaaactcgccgcagcaatgggtgcgctttacggaaacgcagacaaaggacttaacgtaattgccggatttactaccgagcagatagaggaaagcgaaaaattttcaaaaaacgtttgcataaaagccgtaagcggcgtgcctccgctttatatcaaagcaaaaatcaagaccgaagacggcaacgagtcggttgttgaagtcagccattatcatacctttatcactcgtaaagagctaaacggtaccgttttggattcggctacagtgacggaacagaaaaaggtagaggtcaatttcggcataaaagatatattcgattacgttgacggcggtaaaggcgatatggaatttgtggacaagattatcgacgtaaacggctgtatgagcgatgaaggactaacaaaggattacggtttgcgactcggaaaggcaattatagagcatgacaaagcctatgaattgctcggtaaactcgattacatacttgaacgcaccaccgctgcggttgacgctcgtatggcgggagccgatttgccggtaatgagtaattcgggtagcggaaatcagggacttatagcgaccgtaccggtgatggcggcagccgaggctctcaacgtggggaaagaactggaaagaaagtgcgtacttttgagcagtttgatagctatatatattaagtcaaaacacgatgttttgtccgcttattgcggagctgcaatcgcaggaacaggcgttgccgcagcgcttacctatatgatgggcggaaatgaaagtcacgtgcgcatggcgatacaaaattcactcggaaatacgttcggagtgctttgcgacggagctaaagagacttgcagcttaaaggtagccaattgcactttttcggcggtttactccgcatttttggcgcttaagggaaattcacccaagatgaaagagggtataatttgtcccgaggcagaagggactatagaaaacatcgcttcgctcggcaaaaaaacctctggttttttggataaagcattgatggaaataatgctcggataa

SEQ ID NO: 2375 - DNA, 1674 bp, Unknown
  Description of Unknown: Firmicutes bacterium sequence
atgatggattttttgaaagatatagaagattatttgatatgggcgggtgcgccggaagaaaacgtaagaggcgaagtcgtttggagtcaagatcctaaaaacggcgattgtgcttttccgtgttttaagctttctaagtccatgcgcaagtcaccgatgattattgcttccgagctttcgtccaaaggcaacttgcctttattcgtcgcaaggaccgaatgcgtaagcggctacctcaatttcttttttgacagagagcttgtggcaaaggaagtattgctttgctgcaaggaaagaggtgaaacttacgaggctaagcaaagtaaaggtaagactatttgtatcgattattcttcggtaaatatagcaaaaccttttcatatcgggcatttgcttactacggtaataggcggttcgctttatcggatatacaaatatctcggttataacgttgtgggtataaatcatctcggcgattggggaactcagttcggaaaacttatcgtcgcttacctaaaatggggcaaaggcgagcagactatggacagtttgctcgatttgtatgtaaaatttcatagagaagcggaaacaaacgacagtcttaacgacgaagcgagaatgtggtttaagaaaatagaggacggagataagcaagcgacagagttgtttgcggaatttaagcgcattactctcgaagaagtcgataaagtgtataagcgactcggtataacttttgacagctataacggcgaggcattttacaacgacaaaatgcagcctattatagatgctcttaagcaaaagaatttgcttgtggagtctgacggcgccatggtggtcaatctcgacgaatacggtatgccgccttgtcttattttgaagtcggacggcgctactctttatgcgactcgagatcttgccgcagccgtatatcgcaaaaatacttacgatttttacaaaaatctgtatgtagtcgcttatcagcaaaatttgcatttcaagcagttgtttaaagtattggaattactcggttacgattgggcaaaagattgcgtacacgttccgttcggtatggtcagtctcgaaggcgtgggagcaatgagcactagagaaggtaaggtagttaagcttaaggacgtactcagcgaagcagtagacaaaaccaaggcgattatttctcaaaagaatccggagcttgaaaacaaagacgaaactgcggaagcgataggcgtgggagcggtagtgttcggtgcgcttatcaacggcagaataaaggatgtagtcttttccgtggacaaggcgcttaatttcgacggcgaaacgggaccgtatctgcaatatactcacgcaagatgctgttcgatattatccaaaggcgaggcgggtgaggttgattattcgactttgacggacgacgagactttcgaactcgtcagattgctttctcgattcgatcagacggtaactaccgctgccgaacgatacgagccgagtattatatctagatatctaatcgatttggcgcaggcatttaacaaattttatatcggacacagagttatttgcgacgacgaaaagttgcaaagcagccgacttgcgataaccaaggctgtcagagacgctttgcgtaacggtatgagtcttatactgcttaaggcgccggaaaagatgtaa

SEQ ID NO: 2376 - DNA, 411 bp, Unknown
  Description of Unknown: Erysipelotrichaceae sequence
atgaaacaatttcaatgggaacagcttgtatcaagcaaacgcattccccctaatcagcccaaaaacgatctttcccttctgcgcagtgaagtggaaagcgattattaccgcatcatcaacagcgcttcttttcggcgtttacaagataagacccaagtatttccacttgatcaaagtgattttgtcaggactcgtttgacccactccatggaggtttccgctatcgccaaactgatcggcagacaagtgtgtgccaagataaaagcgatgcagccatatagccatgagatcattgaaacattggcaagcgcatcactgatccatgatctgggcaatccgccgttcggccattttggagaaacggcgatccgcaactggtttaagcagcatcttgatgaattgacctatcac

SEQ ID NO: 2377 - DNA, 645 bp, Unknown
  Description of Unknown: Erysipelotrichaceae sequence
tttccgctcaagcatgagaagttatcgaagcagcaggtcgaaacgaaggtaaacgatctgcttgccttggtcggccttgcggataaaaaatatgcctatccttcgcagctctccggcgggcagaaacaacgggtagcgatcgccagagcattggcgtgtgatccaagcgttctgctctgtgatgaagcgaccagcgcccttgatccgcagatcacgcattcgattcttgcactgttaaaggatatcaatcgcaagaccggcattaccatcgtcatcatcacgcatgaaatggcggtcatcaaagagatctgtgatgaggtggcggtcatggaaaacggtgtgatcgtcgaaaccggaagcatcgtcgatattttcgcaaagccaaaggagaagatgacacaggattttgtcaatatggcagcttcggtcaatcgcatttatacgctgatcgaggaaggcaatcctttgacagaactaaaaagcggggaaacgatggcaatgcttcgctacaatgcggacaatacctcacaggcgctcatttccaagatttcaagagaatacggagtggattccaatattatcttcggcaatatcgaagtattaaaagacaagccgatcggttcgctggtcgtggtgttttcaggc

SEQ ID NO: 2378 - DNA, 633 bp, Unknown
  Description of Unknown: Erysipelotrichaceae sequence
atgaaagtcgcaacggtgggaaccggttttatcgtagaatggtttttgacatctgtggaacgaaatgaaggtgcgaagtgtgtcgccgtatattccaggaaagaaacgaccggcagaaagctggcagatcaatatcatgtggaaaaggtctatacggattttacggaaatgttgaaagatgcggagattgatacggtttatgtggcatcgcctaattcactgcattatcattatgcgctggaagcattgcaggcggggaagcatgtgatctgtgaaaagccgtttacttctactgtagatgaattaaagcatttgatccaggtcgcaaaagcaaagcgtttgtttttgtttgaggcaatcgtaaccagacatatgccaaactatcggatcatccgggaacatgtcgaacaactggggaagattcacatggtacagtgtaatttttcacagtattcctcccgctatgacaagtttctcgccggagaaaatcctaatgttttcaatcctgctttttccggcggggcgctgatggatctcaatatttataatcttcattttgtgatgggcttgtttggaaaaccgcaggaagttcgctatgagccaagtcttgctgctaacgggatcgatactgca

SEQ ID NO: 2379 - DNA, 516 bp, Unknown
  Description of Unknown: Erysipelotrichaceae sequence
aaagatcccgcatgcctgtgggatggcaaggaataccgggagcagtgggagcagatccgcaaaggcgagcgtccttttgatcgcaagctggatgcgccgcgcaatacattagctgcccaatttatgcgcaatgaaggcgtgctgcgttcccatcatccactttattctttccttgcatggggcaagtacgcaaaggtgatcgtggaaaagcatccgctgcatttcggcttgaatgaagaatcaccgcttggcaagctttgtgagttaaatggctatgtgctgctgtttggatgcggctatgcttcctgcgccgtatttcaaatggcaaaccatgcgttagatctgccggtgcgtttggtgagcgtaccgattgccaaaggcggggaaacagcgtttcaggagctgttggatatcccttatcaaaacgacgtgtttcaggaagtcggcatggtcatggaggatcgcaagatcgttgaatttatgtatatcaacaatgaccgctgccgtctgttttcc

SEQ ID NO: 2380 - DNA, 294 bp, Unknown
  Description of Unknown: Erysipelotrichaceae sequence
ttgatgattggagcaggctatctctgtcaatttcttgaggcatctgccttttctctcattgcggtctatgcgctttgttcagtgctgctgcatttcaaaaagtatccgagctcgtgcatcgcattaaaggcagaggactttctgatcgtatgcctattactttttatcatgggaggatggtgtatttttttagcaattccgctttccctcgatatgcttgcatatgtctatctttccgcttttttggcttacatcaactatgcatgcggcatgcggtttcgctcccttttctaa

SEQ ID NO: 2381 - DNA, 366 bp, Unknown
  Description of Unknown: Erysipelotrichaceae sequence
atttgttcttttctttttaggaaaaaaagaaatatgacgtattggtataatgggggagggatggcaatgcaccaattactttcactgtgtgaaaaagaacagatcatggcgacgcttgctcatatttataagcgagagcatgcacaggaaacagatgaagaaaggattgcggaaagcggtgctgcttatttgaatcaagagctgtgcgcacgcattgacgccatcctgctatgtatgcctaagaaagatgcggcattgatcaaatcgctctatttgcggccacaatatgaaaaagccgctccgatctataacgaaatcgaaaaaagcgaggcgcttacaagatttttagattgtctaactatgtga

SEQ ID NO: 2382 - DNA, 702 bp, Unknown
  Description of Unknown: Erysipelotrichaceae sequence
atcggaaaagacatgcagtttttcggcgcgcgcgccaatttggcgaaagcactgttgtatgcgatcaacggcggtatggatgaaaagaaaaaagaacaggtatcaccgcgttttgaaccgatcacatctgattatctcgattatgaggaagtcatggaaaaatatgatcagatgttggaatggcttgccggcttatatgtcaatacattgaatgtcattcactatatgcatgataaatacagctatgaagcagcggagatggcgcttcatgatcaggatgttcgccgtttctttgcgaccggtgtagcgggattatccgtcgttgcggactctttatctgcaattaaatatgccaaggtaaaggtcgtgcgtgatgaagatggcatcgcggtcgattttatccgtgaaggcgacttcccaaaatacggcaataacgatgatcgggtagatgcgattgccaaggatatcgtcaagcgttttatgatgaagatcaaaaagcaccatacttatcgtgaaggggtgcattctatgagtattttgacgatcaccagcaatgtggtatatggcaaaaagaccggtgcgacaccggatggcagatcggccggagaagcttttgcgccgggggccaatccaatgcatggacgagactgcaacggggcgctggcatcactggaatcagttgcgaaattgccgtatgactat

SEQ ID NO: 2383 - DNA, 222 bp, Unknown
  Description of Unknown: Erysipelotrichaceae sequence
attggtacgcatatagattggttaaaggcactgatggaaaagcatacctttacgcaagcaaatgcggcagagatcttaaaacaggaaatcgcagaagtgtttgcggaaggattggcacactgcggtgtattcaagctagatcatgcgggagaagaagcgtgtgatcgctttatggagcaggtattgcaaaatacgacgacgaatacaggaggacgaacatga

SEQ ID NO: 2384 - DNA, 624 bp, Unknown
  Description of Unknown: Erysipelotrichaceae sequence
cggacacagagccatctgttttatgcacgccgcatggtaaaaacacatggcttaaaagaatcgacgatcagtgaatatttacaaagccatatggaacagaaaaatcctacggtcgcgacctatgcgaagccatatggcactgatgtgaggatcatggcttctgcgtcatcgctgcatcaggcagaacagatgtgtgaatcctgtgcggcagaggtctgtgccattctaaaagatgcggtatattccatagacggcatgtcgttagaggaaacagcgatcgcacatttacaagaatgcggtcttaaattgatgatcgtggatggcggcagccgcggcgtcctgctttctttgttgggaaaaggtgcgatggaggaagtgcttttggattatcggctcatgcatacaactgtttcatcacctttattggcagcagaagataaaagcaaagagatcttaacggtttctattgcttcaccaaagatggatgcagacgggaaaatgaatgttgcaatcacttatcaaggggcgatagatgaacaggaaatcatttcttcctatcaggatggtgagggtttttataaccggatcagctatgccgtgctcgatcgtatcagacgaatttag

SEQ ID NO: 2385 - DNA, 780 bp, Unknown
  Description of Unknown: Erysipelotrichaceae sequence
gcgcacagtgtatataaccgcatcaacctgacgcaattatcttatacgactttagagatccccaataattttttaatggtgctgcgcaagcatattgacggcggcatcattttatcctgtgagcaggagggactggatcgcatcttgaaaatgcaggtggaaacgcataatgaattgggcgatcggcgcagcatcacgctcatgatcgaactgatgggaaaatacgcgaatctgatcttggtcgatgaagacggcaagatcatcgacgccttaaagcgcattcccccttttgaaaacagcaaacgactgatcctgccgcaggcattgtttgtaccggtggaaaagcaaaaggaaaaaagcgatccgtttcaggcgacgcagatcgacgttcagcgttctttggtcaaacagttttccggcttttctccgcttctcgcaagcgaggtggaatatcgtatgcaaaacaaacaggattttggcagcatcctatcagagatcaaaaaaagcgatcagctttatttcaccgatattgaggaacaaacttttttccatgtcattcctttgacccatttacagaagccggcttacgcgtatccgatcatgaaaggccttgatctgctctatcatgatcaggaagaaaaagtacggatcaagcagcaggcaggcgatctgtttcgactggtaaaaaaagaattgcataaaaaccggcaaaaactgccgaagctggaggaaacccgtaaagaggcgctggattgtgatcagtaccgcatctacggcgac

SEQ ID NO: 2386 - DNA, 519 bp, Unknown
  Description of Unknown: Erysipelotrichaceae sequence
atgatcagagcggttgtatttgactgcggtaatgtgctgaatgcgtttcagccgattgcctattaccgaaaacaaggatatgaaaaaacactttgtgaacggatctgtaaagagatgtttcaaagtgaagaatggcagcgctatgatcagggcctgctcactttttcatcattgatcgagaaattaaaggaaaagtatcaagaggatgcgaaatggatcgatgtgtttgcgaaacagtggctgtatgtattagagatgatcccggcgcatcagcagctgttagatgaattaagtgaacagggctatcgcgtctatttattgtccaatattgcacaggagtcatgggactatgtgagcaagaaagggaattatcgggaacgcttcgatggctgggtgctttcgtttgaggaaaagctgatcaagccgcaggagcagatttatcggatcttattagagcgctatcagcttgatgcgaaggaatgcttgtttttagacgatctgcaaagcaatgtggaggct

SEQ ID NO: 2387 - DNA, 378 bp, Unknown
  Description of Unknown: Erysipelotrichaceae sequence
atgattgcttattcattttttaaggaggcgaatgttatggaaaaacaacaggcaaatccactgggatatgagccgatcgggaaactgctgcgggcgtttgcgctacctgcggtcatctccatgctcattaacgcgatctacaatatcgtcgatcagatctttatcggacagggtgtcggatatcttggcaatgcggccacgaccatcgcttttcctatcgttacgatcattttagcggtaggtacgaccatcggtgccggaggcagtgcctatgcggcgatcaaactgggtgaaaagcgcaatgaggaggcagagctcacactgggcaacgcatttttgctgttaagcatcatcgggatcatcatgacagtgataggc

SEQ ID NO: 2388 - DNA, 510 bp, Unknown
  Description of Unknown: Erysipelotrichaceae sequence
tcaagaaccattcagattttcaagggaatcttgtttatcttcatcatcagggcagttgcttcgatattcggcctgaagacgatcatgatgattgccgatttatttgtaacatggggctttttggcaatcattattatcttccagccggaaatccgttcactgttggaaaaactgggaaaaacaagtgtcttttcccgcatttccactttgacggtcaatgaacgcgaacggctggtcgatgaactggtgcgcgcgtgttctgccatgtcggtatcgaaaacgggcgctttgatctcgctggaacagggacattcactgagcgattatatcaagaccggtacacagatgaattcgatggtaaccagcgagctgctgtgttcgatctttgtaccgggaacaccgctgcatgatggcgcggtcatcattcaaggggtcaagatcgcctgtgccgccgcttatttcccgccgactaccaaggatctgccaagcagctatggggcaagacatcgt

SEQ ID NO: 2389 - DNA, 384 bp, Unknown
  Description of Unknown: Erysipelotrichaceae sequence
ttgcagtatcaaaacaatgaaccgatctatttacagatcattcatgattttaagagcaagatcgtaagcggcgcttatccaccgggatcaaaggtactgccggtgcgggagtgtgccatcgcatatgcggtcaatcccaatacgatgcagaaggcgttgtcgatcttagagcaggagggactggtttataccaagcgtacggccggacgctttatcagtgaagatgccggacgcattgcacggctcaaagaagaaatggtttcagtctatgtaaaacggctgggtagtgaaatgcgttcttttggcatcagtgatgaagtcatattgacatcagtgagagaggagttgaagcgaaatgttgatggaagtacgtcatgtaagtaa

SEQ ID NO: 2390 - DNA, 627 bp, Unknown
  Description of Unknown: Erysipelotrichaceae sequence
gaaactgaattgaaacaagggatcaagtcggctttgaaacaagtatatgacttggaagtagaaaacgactttgtcgtaatcgaaatcccgaaaaatcccgatatgggagattattctacaaatgtggcaatgcgtttggcaaagcagctgcataacagtccgcgtgcgattgcggaaggaatgttggaagcgatcaaggaagcaagtccgtttgtagaaagcgccgaagtagcaggtgcaggtttcatcaacttcaggatcaagaaatcaaaaattgccgatgtaatccataccgtattaaaagaaggggaacattttggggaaaatgaaagcgggaaaggtgtatcgatcctcgtcgaatatgtatctgcgaacccgaccggcgatctgcatttgggtcatgcgcgcggtgcggcgtggggcgattgcattacgcgtctgttaaataaatcgggctataactgcctgcgcgagttctatgtgaatgatgcgggcgtgcagatcaccaagctgggacagtccctgctggcacgttatttacagttgttcggcattgatgccgcattgccggaggacggttaccacgggcaggatgttgcggatatcgccaagatcgtaaaagaacag

SEQ ID NO: 2391 - DNA, 414 bp, Unknown
  Description of Unknown: Erysipelotrichaceae sequence
ttgaccaatgacggtgattttgccaaccagatcatccatccccgctatcatatcgccaaaacgtataacctgacgatcaacggcatcttgaagggcgaacacatgaaagcgatccaaaacggcatcgtgctggatgacggcatcaagacgctcccggctaaattaaagatcactgagaaagatgaaaagaaaaatcagatgtcttttgatctgacaatctatgagggacgcaaccgccagatcaaacgaatgatggaagcgctgggatttgaggtaagaagactgcatcgcaagcagcttggctttttgcgggtagatgatctgagccagggcgaatatcggcgtttgaagccgtttgaggtaaagaagctgcgcacgcttgcggaaaaaggaaaactgatcaatatggagtag

SEQ ID NO: 2392 - DNA, 282 bp, Unknown
  Description of Unknown: Erysipelotrichaceae sequence
atgaaacgatttctttgtgatgcgttgctggtgctggtgatcgtatcgatcatgcactatgattttgatcaagaagtaagcgtggaagaacaagtccgtgattttgaagcggaagtatcacgcgaacagatcgtaaagccgaaaacagaaacggtgcgtttacaggatatcaaagaaaacaaggcgtctgcatcggcacgcggggtttcggagtttatcgtcggtgttaccgaggaaggcgcgcatctgtttggctctttgtttgggggcatcttgcaatag

SEQ ID NO: 2393 - DNA, 705 bp, Unknown
  Description of Unknown: Erysipelotrichaceae sequence
caggcacttaaaagcaagcgtagaaagtgtatgctaggaaccggtgcaatgagtgatccttatcagccgattgaacaggatctcggttatacgcgtaaagcgctggagctggcagggcgttatggatttggttttacattattaacgaaatctgatcgggtcttgcaggatctggatttattgaaagcgatcaatgaaaaaacaaaatgtgttgtacaaatgacccttactacttatgatgataatttatgccgtaaacttgagcctcatgtatgtccgacaagtgagcgcatcgctgttttgaaacagttaagggatgaggggatcccaacagttgtgtggctttgtccgatccttccttttatcaatgatacggtggaaaatatcaaggggatattacatgcctgcattgatgcaaaagtatatgggatcatttgttttgggatggggcttaccttacgcgaagggaatcgtgagtatttttatgagcaactggattgcttgtttccccatatgaaggaaagatatattaacacttatagtatgctttatgaggtggacagtccgaaagaagcagagctgatgcagttatttcatcagctttgtgaggaaaacggtattgtccatgataaccgagaaatattcacttatctatcaactttcgagacgaaagagtatgctgttcagttgaagttgtttgaatga

SEQ ID NO: 2394 - DNA, 579 bp, Unknown
  Description of Unknown: Erysipelotrichaceae sequence
atgaagaagcgtgatcgcattttgatcggctgcctacttgtcttgcttttgcttgtcattagcatcatgtggatgagccgggaaaaaccgttggctgaaaaaacagatcgcattgcgatactcggttatcatcatttggcagaagacggtgataaatatcgtgaatatttgtttgatccatggacggcaacgctatcctcatttgaaagacagatgcgttatctgaaggagaacggttatcatacgatctcccttgatgaactttatgagtggtatgaggggaagcgggaattagacagcaaggcagtggtcatcacttttgatgatagttattattccacctatgaactggcgaaaccgatcttggaaaagtatggctttgaagcgagcacctttgtgatcggatacagcattccatatgactatgaaaaatgggatccgccttctaaagcacatattccatatgatttactgcaagatgatcgcacgatgcgctactattcgcacttttaccatctgcaccgtaagatcgaaggcacgtatgcggtcaatgtttatagtgaaaaagaactgatcgaa

SEQ ID NO: 2395 - DNA, 666 bp, Unknown
  Description of Unknown: Erysipelotrichaceae sequence
atgtggaattttgcggtaatgggacttggcggcatagcaaaacgggtcatagaggggatcgtattaacaccttctgcgtgtctgtatgcggttgcttctcgtgatgttagcaaggccgaagcgatcagggaaagcagcggtgcgaagaaggcatacggtgattatgaagcaatgctggaagatccgctagtcgatgtcgtttatatctgtacgccgaattatctgcaccatgcacatatcatggcggcgcttgcacatcataagcatgtgatctgtgaaaagccgcttgtcagcaatgaagcgcagctgcgggaatgttttgcttatgcgaaagagcagcagtgctttttgatggaagcggaaaaaacgctgtttacacccttaaatcaaaagatcaaagaaatgatcgaggatggggtgatcggcaaggtttcttacattgaaggcagctatggctttttgcttccaagcgagggtttatccacttcttattggggtatcggaaggaagacggcggctgcttttatgatgtcggtgtttatccgatctgttatgccaattattttgcggacagtgagatcaaacaggtgcagtattgtgaaacgcgggcagcgcgcggctatgtggattttgcgcaggcgctcatcacttatcaaaacggggtga

SEQ ID NO: 2396 - DNA, 696 bp, Unknown
  Description of Unknown: Erysipelotrichaceae sequence
ccgggcctgatctccgcgatttcgattgcggcctacgtctttgtggtattctttatctataacctgatgggcggcgtctttacgctttccggtttagcggcgctggtgcttggcgttggtatggcagtggattccagcatcattacttttgaacgtatcaaggatgcgctgtacagcggtcgcagcatcaaaagcgctttttatgaaggaacttcaaaatccttctggacgatctttgactcacagctgacgacgtttatctccgctattattttatttgcgctcggtagtggttcggtaaagggctttgcgacgatgttgatcgtttcggtcgtggcaacgatcacactgatcgtcggcattgtacgtttcctgttaggacagctggtagaaagcggtatgctggatggaaaactcagctggtttggcgtcaagcaagatcaggttgccaatgtggcaaagggggaagaacgattctatttcggcttcttccatcgctttcagtttgtcaagaatgcgaaatactttgtggcaacatctttagcgatcatcgtcattgcgattggctgtatgggcttttctatcgcacagggaaaagggccgttccatttgggcattgatttcgtgagcggcacgaaaataaccgttcaaagcgatcagaaattaaatgaatcggacttaaaagcagatcttgcc

SEQ ID NO: 2397 - DNA, 447 bp, Unknown
  Description of Unknown: Erysipelotrichaceae sequence
atggatcaaatcagcgcattaagggagtggatcacagcgatcgtggaacaaaacggcatgcttgtttatgatatttcttggcagccgatgggaaatatgaaaagcttgcaggtatcgatcatgaaaggggacggcacgatggatctggacagctgcgcgatgatatcggaacagctttccgctatgcttgatgaaaaagatctgatcaagcatgagtattatttagaagtctgttcgcccggcgcggaacgagaactgcgaaactttgaagaagtaaaggcggctgtgggcgaatatgtgtatgtaaaattgaagaatgtcatggccaaagggatttacgaagtgcttggcacattggaaaagtgtgaagaagggatgctttccatgacatatatggataaagcgagcaagcggaaaatcgatattgcctatgacaatgtcgccttg

SEQ ID NO: 2398 - DNA, 309 bp, Unknown
  Description of Unknown: Erysipelotrichaceae sequence
atgactgaacaaaaatcagtgaaagcactaccggcttgtcctgtggaaacaaccttgactttgatcggtgataagtggaaagtgctgatcttgcgtgatttgcttaccggcacaaaacgttttggtgaattaaaaaaatcaatcggctccgtatcgcaaaaggtattgaccacgcagcttcgagcaatggaggaaaacggtttactgacgcgtaccgtttatgcggaagtaccgccgcgcgtagaatacaccttgacggcattaggcaaaagcctgcatccgatcctggacgccatgcgagacttcggt

SEQ ID NO: 2399 - DNA, 411 bp, Unknown
  Description of Unknown: Erysipelotrichaceae sequence
atggaaaacgcggcgagcaatgaagcgggcgcctttaccggttttttaggaatgggcatggctgcacaggccggaggcatgcaaaatggtgcgctgtttgaacagatgagcacacgagaagataatccattgttccaaaaaccacagcgagcaggtggaacggatacttggacatgtagctgtggacatgaaaacagcggtaaattctgcagcgaatgcggcaaggaaaagccaaagcaggatacatggacatgtgcgtgcggacatgaaaacagcggcaagttctgtagtgagtgcgggaaacctcgtcccaaagaaggttttgtttgttctaatgaagcatgcggttataccagcgatgagccgatgaagttttgtccacagtgcggcagtcctaataaagaagaataa

SEQ ID NO: 2400 - DNA, 819 bp, Unknown
  Description of Unknown: Erysipelotrichaceae sequence
cctcaggagatcggcgatgcgattgccgatgccggatttaactgggtctcacaggcaagcaatcattcattggatgccggcgctgccggaatcatttcggcaatggatttctgggatcgttatccggatgtagttacgactggcatcaaccgcagtgaagaagaagccgcacgtccgcgcatcatggaagtaaaaggggtcaaggtcggcctgttgaattacagttatggctttaacggatatgtagagccggaagatttttattgcaatgaaattgataaagcgaagatcaaaaaggattatgaacagctgaaagaagcgggctgtatcgttgttcttgccagtatgcactgggggcaggaataccagttttcttcaaatgaagaacagcgtgaattggcgcagtttttggcggatctcggcgtaaatgtcatcattggcgcgcatccgcatgttgttcaggaaacgacctttcttaccggaaagaacggaaatcaaacacttgtaaactattccctgggaaatattctaagcgcgcaagatgaaaattacacgatgctgggtgcgctcatgacttgtgaaatcgtaattgacggaaacagcaacgaagttacgatcgaacaggcaaaggtatatccgacggtcaattactatgaggcatatggcggctcttggcataatttccaaatttatctgctgcgcgactataacgacacgctggcatcgactcatgccgttgccaatacgaccgtagcatatttgaatgacctgtgtgatcaggtatatggggaggtgaaggacatcgaaattgtccgctga

SEQ ID NO: 2401 - DNA, 2493 bp, Unknown
  Description of Unknown: Firmicutes sequence
atggcaaatgagaacaaatccgcccagcgcggtgctgataaacccaagcgaaacggatggcgcgtgttcgggcgcgtgatcgggacgatcgtgctcgtcggcgtgctgacggtgctggtgttcgcatgtctgtttgcgctgtatgtcaaaaatgacctcgcggcgcagaacaatttttcgctcgagggcttcgcgctcgaccagacgtcggtcatctattatgaggacccgaagacggggcaggatgttgtgctgcaaaagctctacggcggtgcgaaccggacgtgggtcaaatatgaggacatcccgaaaaacctcatccatgcctgcattgccatcgaggacaagcgctttatggagcatcagggcgtcgactgggtgacgacgatgcgggcctgcttgaaaatgttcctcggcagcggcagcgccggcggctcgaccatcacgcagcagctggtgaagaacgtgacgggcaaccgcgaggtgacggtgcggcggaagctggcggaaatttattccgcgctgaagcttgagaaggaatacaccaaggaagagatcatggaatggtatctcaacgtcatcgcgctcgggcagaactgcgagggcgtgcagtcggcggcacaggtgtatttcgggaagaacgtggaggagctggatctggcgcagtgcgcgtcgctgatcggcatcacgaacaacccctcgatctatgacccgtatctcaaccctgagaagaacaaggagcgccaggagatcatcctcggcgagatgctgagccagggctatatcacgcaaaagcagtatgacgaggcgaaggcggaggagctggtcttcgtgcgcaaaagcacggacgacagcgatgccgacgaggaatactattcctatttcgaggatcaggtcatccgcgacgtggtcaacgacctctgcgacaaaaccggttatgattatgatatcgtctataagatggtcatgaccggcggctatcagatctacagcacgtataaccccgacgcgcaggcggcggtggatgcggtgtatgaggatctgagccagatcccggagacggccagctcgcagcagctgcaatccggtatcgtgatcattgataatgagacgggcgacattgtcgcgatggcgggcggcgttggcaaaaagagcggcagtctgacactgaaccgcgcggcgcagagcctgctctcgcccggttcgacgatcaagcccgtgtcggtctacgcgccggccatcgagctggggctgatcacgcctgcaacggtctatgacgacacgccgtattcgttcaccgacaattcgttctggccgaaaaactcggactcgacgttccgcggcctcgtctcgatcaacgaggcgatgatggagtcgctgaacaccgtgccggtcaagctggtggcggagatgacgccggaatattgctatcaatttgcaaaagagaaaatgggcctttccacgctggtgtccgactatgtgacgagcagcggcgaggtgcgctccgatgtgaacctcgcgccgatggcactcggcggtctgaccaacggcgtgaccgtgcgggcgatggccgcggcctatgcctcgtttgctgacgaaggcgtctatcgcacagcgcggacgtatacgaaggtgacggacgcgagcggcaagaacatcattctggacaacacgcagaattcgtatcccgcgatgaaggacatgacggcgtggtatatcacggatatgctggagaacactgtgaactacggcacgggctacggcgcaaagctcgaaaacatgaccgtcgccggcaagaccggcacgaccacgagcgactttgaccgctggtttgcgggctatacgccgtattatacgggcgtcgtgtggtgcggatatgacgatccggaggaggtcgtgctgacgaattcggagacgaaccccgccgtggtgctctggcagaaggtgatgagcacgctgcatacgggccttgccaacaaggaattcgcgaagccgacgaacgtcgtcgagtgtacggtctgccgcgacagcggcaagctggtcacggacgcctgcaaggaagatccgcgcgggagccgcgcggtgaaggtgcagctcagcctctacgacgtgccgacggagaactgcgacgtccataccgaggtcgagatctgcgacgcctcgggccacgcggcgaatgaatactgcgcgctggtggacggcaatacgacgcacaacgtcggcctgctgaacatttcccgcgcgttcccgacggcgggcatcgtggtgctcgaccagtcctacgtcgtgccgaacgacagcctcccggcagggtattacgcggcggtcgcgccggatgtggacgcgatcaatgtcccgtgctatatccacgacgcggacgatctgccaaaaaaagaagaaccggagccggatgaggacgagcagtccgacccggacgacgaagatacgaccgaaccggatctatggaacgcggataccggtttgaatccataa

SEQ ID NO: 2402 - DNA, 2757 bp, Unknown
  Description of Unknown: Firmicutes sequence
gtgtatgaacagaaggaggcgaagtgtttggctgagctgaagcttgtttcgccgctgctttccaatatggaggtcgtgtcgtgcatcagtgcgcgcggtgcggtatcggtctatcttgtgaaaagcacaaaaacggcgcaaacctatatcttaaaacacatctccgttccggagtcgcagaagcaggtggacgcgctgctgttcaccggcgcggccagttcgacggaggatgcgcagaaatactacgaacaggtcgtcacggactatcgcgaagagctggagacgctggagcagctggcggccagcccgaatctggactgcttccgcagctatcagatcgaaccgaaggaggatggcgtcggctttgacatctatcttctggccgagcaccggacgacgctgagcgagtatctggcggacaacgccatcacgcacctgtgcgcggtgaaccttgcgatggatctttgcagcgcgctggtcgatctgcgggcggcgggtctcgtccatcgggacgtgaagcccggaaacatctacttaaacagccagggccatttcgtgctcggcgatctcggcattgcgaagatcgaagagctgaaatactgctcaatgccggagaacatgctctcatcgtattccgcgccggagctgttcagcctcgtcggatcgatcgagccaacgacggacatctactccgtgggcctgatcctctaccgcatctacaacggcaaccacgcgccgtttgaagatgagcgcacgtcggccaaggcggcggacaagctccgcatcacgggcaaggatctgcccgcgccgatgtacgccgactatgagatggcagagatcatccacaaagcgtgcgccttcaagccagaagaccgctatcaggacccaaacgagatgaagcaggccctggtcgagtacatgaagcgcaaccagtcggacgacacgctgatcgtcccgccaatctccggcgagatcgagccggtcgacccgaacgccgaggacgaggtcgagccggtgcagttcgcggacagcgagtcaatggccgaggacttcaaagagaacttctcgccggacacgcagatgctcaacgacatgatcgagagcgtccaccgcgagatggatcgcgacccggagagctattacaacacgctcgagccggacgacgaggatgatgacatcccagtcgagtccggcgtgaagaagcgaaagcggaaaaagcggaacaaatggctccccgcggtcatcagcctcgtgctgctgctcgcgattgcgggcgcggtggcctattttgtgttcatccggcccgcgaccgtccacatcaacgccatttccctgctcgatgtctcgaccgacacggtcagcgtgttcgtcgattctaacgaggctgacggtgcgttcgacatcctctgcaccgattcctacggcaaccagtcgcggcaggcgttcgcttccggcgaggaaaccatctttaccggattgacgccggggacgcagtacaccgtctccatcgacccgctgaacaagaagaacgtcacgggtacgtcgcagctgatggcgacgaccatcgcgcagacttcgatcctcagcttcacggccacgaccgtcacggtcacacaggcggagctgaacctgatcattcaggacgggccggaccccggcgtgtggaccgtggaatacagcgcggacggcgtggagccgaagacggcgacgttcaacggacactccacggtggtggccgggctggaatctgggaaggattacaccttcaccctgcaagaacctgaagggacacgcctgaccggccagacgaaggcctacttctcgaccgttccggctgtcagcatcacgggcatcaaggccgcgctctccagcacgacagcgatcctctcgtggacgatcgagggtgacgcacccgagaactggaccgtcgaggtcacaggcccggacggctacgcagattcgcaggtcgtcagcgcaccgaccgtcacgctcgaagggctgacctcgggcgagacatatgaggtcatgatctcgacgccgacgatgttggaaaactgctcaaccaagatcacgccgaacgtcacagcgctcacgagcttcacggcagagccggatctcgaggccggaacgctgaacttcacgtgggagtgcgagaacgagcctgccgacaacgcatggacgatcaccgcacggctccacagcgagaacaatgagctggtgcagtacacgtggacgccggaggccaacacgaacagctacaccgtcgatcttgccgatttgctcccggagcgggaatatgacttcacgctgaaccttgcgagcggcgacaagctggacggcgagaacgtcaccggctacaccacgccgaacaaggacaagttccgcagctatggcacgaaggacttctatctcggcttgttcctgaaaccggacagcgacacgttcacgagtaagaacctctccgtctcccggacgagctttgacaccgacgaattcgttgcgttcgcattgcagtccatcaacaatgtcaaggattcgggcgataccgtgccatacacgatggtgctgaccgacaaggacggcaagatcgttgacgcggagttctcgagcatcacgtggaacggcgcatggacgcgcaacatcttcgcaggcttcttcccgcgcatgccgcaaaccgccggtgattacaccctgacgatctatttcaacaaccagtttaccgccgaaaaggctttcacggtaaacgccgcgcaataa

SEQ ID NO: 2403 - DNA, 3453 bp, Unknown
  Description of Unknown: Firmicutes sequence
atgggcttcgtgcatctgcatgtgcataccgaatacagcctgctcgacggtgcgtgccgcatccgcgacatcatggcgcgcgtgaaggaggtcgggcaggaggccgtcgccatcaccgaccacggcaacatgtacggcgtgatcgacttctaccgcgcggcgaaagccgcgggcgtgaagcctatcatcggctgcgaggtctatgtcgcgccgcgcacgcgctttgataaggagcacgcgttcgaccgcgaggcgtatcacctcgtgctgctctgcgagaacgagacgggctaccgcaacctcagctacatggtttcacgcgggtatctcgacggcttctataaccggccgcgcgtcgatatggagctgctgcgggagcaccacgagggcatcattgcgctctcggcgtgccttgccgggcgcgtgccgcaggcactgctgcacgaccagtatgaggaggccaaaaaggccgcgctggaatacgcggagatcttcgggccggagcatttctatctcgaattgcaggatcacggcctcgaggagcagccgcgcgtcaatcagggcattctgcgcctttcacaggagaccggattgccgctcgtcgtgacgaacgacgcgcactacctccggcgcgaggatgcgcggacgcaggatatcctgatgtgcatccagatgggcaagaccgtcgacgatccgaaccgcctgaaatttgagacggaagaattctatctcaaatccgaggaggagctgcgcgagcggttcccgcaggcggacgaggcgtttgaaaataccgtgaaaattgccgaacgctgcaatgtggaattcacgtttggaaaatatcacctgccggaattcaagctcccggcgggatatgactcgctgacatacctgaaagagctttgcgccaagggctttgccgagcgctatggcgaagcgcatccggaataccggcagcaactggactatgagattgacatgatcgagaagatgggctttaccgactacttcctgattgtggcggactttgtcaactttgcaaagcaggcgggcatccccgtcggccccgggcgcggaagcgccgcgggttcgatggtcacgtatacgctctacatcacggagatcgacccgatgaagtacgggctgttcttcgaacggtttttgaatccggagcgcgtgacgatgcccgatattgatatggacttcggcgacacgcggcgcggcgaggtcgtggactatgtgcggcggaaatacggcgacgaccatgtggcgcagatcgtcacgttcggcacgatggccgcgcgcggcgcgatccgcgacgtgggccgggcgctgaacttcacctatgccgagacggacgtcgtggcgaagctcgtgccggggacgccgcacatcacgctggacgaggcgctgaaagtctcgccgcagctgcgcgagatgtacgagggcgacgagcgcgtgcagaccctgatcgatacggcgcgcgccctcgagggtatgccgcgcaacacatcgacgcacgcggcgggcgttgtcatcacgcgcctcccggtctacgactatgtgcccctcgcgacgaacgacgacacgatcgtcaccgagtatacgatgacgacgcttgaggagctgggcctgctcaagatggacttcctcggtctccgcaacatcacggtcatcgacgatgcgatccaggagatccggaagacagaccccgatttttcgatggcccgcgtcactgacaacgacccgaaggtcatggacatgttgacgcaggggaagacatctggcgtgttccagatggaatcatccggcatgacgggcgtctgtgtggggctgaagccgcagtctattgaagacctctccatcatcgtcgcggcctaccggcccggcccgatggactcgatcccgcggctcattgcctgcaaaaacgacccgaagctcgtgcagtacaagcacccgatgctcgagccgattctgtctgtcacctacggctgcatcctctatcaggagcaggtcattgaaattttccgcaagctcgcaggctattcgctcgggcaggcagacatggtgcgccgcgcgatgagcaagaaaaaggtgaaggacatcgagaaggagcgcggcgcgttcctccacggcgatccggcgcgcggcattgccggctgcgaggccaacgggattccggtcaaggttgccgaggacatctacaacgagatgtacgatttcgcgaactatgccttcaacaaggcccattcggtctgctatgcggtcatcgcgtatcagacggcgtggttcaaatattactatccgaaggaatatatggcggcgctgatgacgtcggtgctcgacagctcggtaaaaatttcggaatatatcgccgagtgcaagaacatgggcattgcgctcctgccgccggacatcaacgaatcgaacgaccattttaccgtcgtgccgaacggcatccgcttcggcctcgcggccatcaagaacatcggccgcggcttcatccagaaggtcatgcaggagcgggaaaacggcggcccgttcccggatcttgaaagcttctgtaaccgcatgtacggcacggatctcaataagcgtgcgatggaaaacctcatcaagtgcggcgcgtgcgactgcttcgggctgcggcgttcgcagctgctggccatctacgacgccgtgatggagtctgtcgcggccagccgccgcaaaaacgtcgagggacagatgggactgttcggcatgatggagggcgatgacgcgccggtctctgacattcacgtgcccgatctgccggagctttccgcgcaggagcgcatgagcatggagcgcgagacgacgggactctatctctccggccatccgatggacgattaccgcgaacagctgaagggcacgggcgttgtgcccatcgggcggattatgcagagcttggaagatcatgacggcgtctatcaggacgagcaggtcgtctccatcgcgggcatcgtccagacggcaaagatgaaaacgacgcgcaatcagagcctgatggcctatgtcacgctcgaggacaacacaggcagtatggagctgcttgtcttctccagcacgctgaaccagtacggcagcctcatccacgagggcgcggccatcgtcgtcagcgggcgaatctccatccgcgaggacaaggatccgcagatggtggtgaaccgcgtctgggccattggtgacgtacaggcggcacagcaggatgccgcgccgcagtatcatacgctctatctccgcgtcgccaggaccggccagaagggcgagcagaagctgctgcccattttgcatatgttccccggcaagctgaagaccgtcatctactacgccgacaccggcgttcgccgcggcggaacgtgcgcgccgcaggaggtcatgctacaggagctgcgcgaactgctcggcgaaaaaaatgtggtcttaaaataa

SEQ ID NO: 2404 - DNA, 2109 bp, Unknown
  Description of Unknown: Firmicutes sequence
atgcagcgaagaatgcgcttccgcatgatcgtgttcatctgcttcatcgtggcgatgatggcggtgttcgcgctgcggctttataaattacagacggcggaactcgtgaccgcagacgcggactcgatgacctaccgcaccacgatggaggcctcgcgcggcaacatcctcgaccggaacggcaacgtcctcgtctcgaaccgcgcgagctataacctcgtgatcatcaacttcgtcctcaccaacacgggcgcgacgaacgaaaacctgctgaagctgctcgacctctgcgaccagcgcggcatcgaatatgaaagccatttcccggtaacaatggagcggccttatgcctatcagatggacggcatctcgtccacatggcaggattatttccgcgcattcctgcgcaaccgggaatatgacctcgacacgacggcctcgacgctgatgaaaaagctgcgcgaggattataacatccccggtgactggacgcaggagcaggcgtacaaggtcatctccgtccggtatgagctggagctgcggagcgtcgagggcgtggggctggaaaactacacgctggcgaccgacgtcagcgcggaggatcttgcggcggtgatggagctgagtattccgggcgtgattgtcgaatcgagcaccgtgcgcgtctacaacacgaagtacgcggcgcatctgctcggttccatcggcagcatcgaggctggggactggccggaataccgcgacaagggctacgcgatgaacgcaaaggtcggcaaagagggcatcgagctggcctttgaggaatatctgcacgggacgagcggcatgaagtatacgaccgtctcgtccacgggcgaaaagctcgacgaatactacaccagcgtcccgcagccgggcaacaacgtggagacgacgctggacatctcgctccaggccgtggcagagaatgcgctggagagattgattttggacctccgcgaaaacggcgtcggcgcgcacagcgaaggcaaggacgccgagggcggggccgtcgtggtgcaggccgtgaagacaggcgagatcctcgcctgcgcgagctatccgacttatgatctttccacctataaccgcgatttcaaggagctgagcgaggacccctataagccgctctacgaccgggcgctgctcgcggaatatgcccccggctcgatctacaagatggtcacggccatcgcggccatcgacatgggccacatcggtgaatactatgagatcacggacgagggcgtctacatgtactacgcaaaggaaaacttcacgccgaagtgctacgtgtggacaagctcgaacgcgacgcacggcaccatcaatatgcaggaggcactggccgagtcctgcaactactatttctatgaagcgggccgcctgacctacaacgcctattacagtgagacgggcgagaatccgtttgatattgtggcgaaggccctcggcctcggcgagcacacgggcatcgagttgtttgagtacaccggccagcgcgcgaacgccgagacgaaaaaggccaactacgcgggcgacgagtccggctggtacggcgcggacgttttgcaggctgtcatcgggcagagcctgaaccgcttcacgccgatgcagatggtctgctatgtgcaggcgctggcaaacaagggtacgcgctattccgcgacgttcctgtcgcgcatcgtgtcgtgggactatcagtcgctgatcaaggagcacgagccggaggtggccagcacgctggacatctcggacgaggcgctcgactgcatcgacaagggtatgcgcatgaccgccaaggtgggcacggccaagaactatctggccaattatccgatcgaggtcgcctgtaagaccggcacggcccagtggcagggcgtgacgtccgacggatctgtcagcggctccgacaacgcctccttcgtgatctacgccccggcggacgatccggagatcgccatcgcggtctacgtcgagaagggcgcgcagggcggtaatcttgccaatgtctgcatcccgatcatggatgcctatttctcgggcgagacaaaatatgaaacaatattgaccgagaatacagttcattaa

SEQ ID NO: 2405 - DNA, 2808 bp, Unknown
  Description of Unknown: Firmicutes sequence
atggaatacaaaaagacgctcaacatgagcaaatccggcttcccgatgcgcggcggcctgccgatgcgcgagccggatatgctccagcagtggtacgacatggacctctaccacgagctgctcaagaaaaacgacggcaagccccgcttcgccctgcacgacggccctccgttctcgaacggcgcgctccacatgggccacgcactgaacaagtgcatcaaggacttcatgatccgctccgcggcaatgcgcggctattatacgccctacatccccggctgggacaaccacggcatgccgatcgagtccgccatcatcaagcagaacaagctgaaccgcaagcagatgtccgtcgcggccttccgctccgcctgccacgattttgcccagcattatatcgatgtgcagatggagggcttcaagcgcctcggcgtccttggcgattgggagcatccgtacaagaccatgaaccccggcttcgaggccgaagaggtcaaggtcttcggcgcgatgtacaagaagggctatatctataagggcctgaagcccgtctactggtgctaccacgacgagaccgccctggccgaggccgagatcgaatatcaggacgacccctgcaccaccgtctatgtcaagttcgccatgcacgacgacctcggcaagctgagccatctcgacaagtccaagctgaacttcgtgatctggacgaccacgatttggacgctccccggcaacctcgccatcgcgctgcacccggacgagagctatgccgtcgtgaagaacgaggacaacggtgagatgtatattgttgccgaggccctggccgagaaggtcatgcgcgtgggcaatgtcgagcattacagcatcgtcgagacccatccgggcagcttctatgagaacatgctggccgatcaccccttcctgccgaagaccagccggctggtgctggccgattacgtcacgatggactccggcacgggttgcgtccacaccgcgcccggcttcggcgccgacgactatcagacctgccgccgctatggcatggacatggtcgtccccgtcaacgatcagggccgccacaccgactatgccggcaagtacgaggggatgctcgtcgaagagtccaaccccgtcatcctgaaggacatgaaagaatccggccgcctcttcgcctccgaagagatcgtccacagctatccgcattgctggcgctgcaagaagccgatcatcttccgcgccacgccgcagtggttctgctcggtcgactcgttcaaggacgaggcctgcgccgcgtgcgacgacgtccgctggatccccggctggggcatcgaccgcatgaaggccatgatccgtgagcgcgccgactggtgcatctcgcgtcagcgccgctggggcctgccgatcccggtcttctactgcaaggactgcggcaagcccgtctgcaccgacgagaccatcgccaacatctcgaagctcttcggcgaattcggctcgaacgtctggttcgagcgcgaggccgacgaactcgtccccgaaaacttcgcctgcccgcactgcggcggcaagcacttcgacaaggaaacagacacgctcgatggctggttcgactccggctccacgcacttcgcctccatgcagaaggatcagggcttctggcccgcgaccgtctatctggagggcctcgatcagtatcgcggctggttccagtcctcgctgctgaccgctgtcggcgcactgggcaagggcgctccgttcaaagagtgcgtcacccacggctggaccgtcgacggcgagggcaaggcgatgcacaaatccctcggcaacggcgtcgatcccgccgacgtgttcaagaaatacggcgctgacatctgccgcctctgggcaggctctgccgactatcatgtcgacgtccgctgctccgacgccatcttccagcagctgagccagaactatctcaagttccgcaacaccgcgaaattctgcctcgacaacctcgtcgacttcgacccgaaccacctcaccgcgcccgccgacatggcggagctcgaccgctgggccgtcacgaagctgaacgacctgatggcccgctgcgagacggcctaccagaactacgagttcttcaccgtctcccacgccgtcaacgacttctgcgtcgtcacgctctccagcctctacctcgacatcatcaaggatcacctctattgcgacggcgcggattccgcctcccgccgcagcgcacagtccgcgctctggatgatcctcgacgcgatgacgaagctcttcgcgccgatcctcgccttcacctgcaacgagatctggctccagatgccgcaccgcgcctgcgacgacgcgcgcaacgtcgtcctcaacgagatgtccaagccgtacacggactacgccctctccgccgaacggatggccgcgtgggacttcgcgttccgcctccgctcggatgtcaacggcgtgctggaaactgcgcgcgccgacaagcgcatcggcaaatcgcttgaggcgcacgtcgccctgaccgccgtcgacgcagccgccggcgaggccgtcaaggccgtggccggcatgaacctcgccgagatcttcatcgtctcgaacgtctccgttaccgatgaaaagccgaaagaaggcgcggttgtcggcagcggcacgaacttccccggcctcaccgtcgccgtcaccgaagcgaagggcacgaagtgcccgcgctgctggatgcactcgaccgaggccgacgagcacgacctctgcccgcgctgcgccgcggtctgcaaggccctcgccgttacgtttgattaa

SEQ ID NO: 2406 - DNA, 2385 bp, Unknown
  Description of Unknown: Firmicutes sequence
atgaatatttcgagaaactggctcaaagagtttgtagatattgaggcgactgaccgcgaatacgacgagatcatgacgatcgcgggccagaaggtcgagacaacaacgcgcatggacgccgagatcaaaaatgtcgtcgtcggcaaggtgctctcgatggcgcggcatgaaaattccgaccacatgtgggtctgcatggtcgacgtcggcgcggagcagcccgtccagatcgtgaccggcgcgcagaacgtccacgagggcgaccttgtgcccgtggcgcagcacaattcctggctccccggcggcgtgcatatcacgaagggcaagctccgcggcgtggagtcctgcggcatgctctgctcgttcaaggagctgggtctgacgcagaacgatgtgccggacgcatacgaggacggcatctggattctgaacaacgaggactgcaccgtcggcgaggacatcaaccacgtcatgggtacggacgattcgatcgtcgaatttgagatcacgaacaaccgcccggactgctattccctgctgggcctcgcccgcgagaccgccgcagcgttcaatgtcccgatgcagcaccatgagccggtcgtcaagggcggcgcggagggcgtcctgcccgagctgctggatgtcgaggttcctgccgaagatctctgcctgcgctacaccgcgcgcatggtgcgcaacgtcaaaattgcaccttcacccaagtggatgcgtcagcgcctgcgctccgccggcatccgaccgatcaacaacatcgtcgacatcacgaactatgtcatggtcgaatacggccagccgatgcacgccttcgattatcgctatgtcaagggcggcaagatcatcgtccgccgcgcgggcgaggacaagacgctcaccacgctcgacggcagcgtccgtcagctccagcccgacatgcttgtcatcgcggacgagacgaagcccgtcggtctggccggcatcatgggcggcgagaacagcgagatcgtggacgacaccgtcgacgtcgtgttcgagtcggccaacttcctcggcgcatccatccgcaagaccgcgctggccctcggcatgcgtaccgatgcttcggcgaaatttgaaaaggacatcgacccgatgctgaccgttccggcggtcaaccgtgcatgtgaactggtcgagatgctcggcgcaggcgaagttgtcgacgggatgatcgacattctgaactatattccggagcctgtcacccttccgcttgagcctgccaagatcaatgccctgctcggcaccgacattcccgaggccgacatgattgagtatctgcggcgcgaggaagtcccagtcgtggacggcatggtgcaggttccctcgtggcggcccgaccttcgctgcatggcggatcttgccgaggaagtggcacggtattacggctataaccggattgagacgacgctgatgcgcggcgcgacgacgatgggcggctattccgagacgcagaagctggagaacgcggcaggcgcggcagcgcgcgcgatgggctacagcgagatcatcacctattccttcgtctcgccgtccacatttgattccatccgcatcccggcagactctcccctgcgcaaaaccgtcaagctcatcaacccgctgggcgaggatcgctcgatcatgcggaccgtcatcctgccgagcatgctggacattctggcgcgaaactttgcgctgaagaacaagggcgtcaagctctatgagctgggcaagatctatctcccggtcgagggccagaccctccccgatgagccgaagcgcctgatcttcggcacgtatggcgagcacgaggacttcttctcgatgaagggcgagatcgtcgcgctgctcgagcagctgaacgccaagcccgcgacgttcgtcgccgagaagcagaacccgagctaccatccgggccgctgcgccaacattctcatcgacggcaaggtcatgggcgtcctcggccagatccatccgctgattgcggagaactacggcatcggcgcggatgtgtatgtcgcagagctggacttcacagcgctcgagggcgcgctggagccggagcgtgtgttccacagcctgccgaagttccccaccgtcacgcgcgacctcgcgctcgtctgcgacgagtccatcacggtcggcgcgctggaggactgcattgcggaagcgggcggcaagctgctgcgcaagatcgacctgtttgacatctatcgcggccccggcatcgcaccgggcaaaaagagcgttgccttctcgctcgagctgcgcgccgacgaccggacgctgaccgacgaggactccgtcaacaccgtcaaccgcgtgctggacgcgctgcgcgaaaagctggacgtcgtgctgcgctga

SEQ ID NO: 2407 - DNA, 1863 bp, Unknown
  Description of Unknown: Firmicutes sequence
atgcgccgctttttattgacggagcagtttactctgatggaaagcgaggggaagcgcttgaatcaacgaacgcaaaagacgggtaatgggcgcacactgctccggcttctgcatggaagctggagctattttctggtctgcatcgtgtcgggcctggtgtttacgggctgcgagctgctcatcccgcagatcatccgcgtgagcgtagactcgttcatcgggaatgcagcggtgcatgtccgggcggcggaacgggtcgttgcggcgctcggcgggacggagcatattcgtggtgcactctggattccggccgcggtgctggtgggtgtcggtctgctctcggcaatgttccgctttttgacgaacctctacagcgcaaaggcgggcgaaacactcgtcaagacgagccgtgatctgctctatgggcacattcagcacctgccgtgggcgtggcactcgaaaaatccgaccggcgacatcatccagcgctgtacgtctgacgtggagcgcatcaagcagttctttcaggagcagttcgtcgcggtgttccgcatgatcgcgatgatcgtgctgtcgctgacgtgtatggcgctgatgaactggaagctggcgctcgtaccggggctgatgttcccgatcatcgtgggctattcggtgctgttccacaaccgcatccgcgaccggttcacggcctgcgacgagagcgagggcgtgctctcgacgatcgcgcaggagaatctgaccggcgtgcgcgtggtgcgtgcgtttggccgcgaaaattttgagcgtgagcggtttgaaaagcaaaatcaggaatatacaacgctctgggtgcgcctctgcaagacgctgtcggatttctgggcggttggcgatacgacggcctgcatccagacgatgctggtcgtggtgattggcagtctgctctgcgtgcgcggcgagatgaccgagggcgactttgtgtcgttcgccatctacaacgccatggtcatcgggccggtgcggcggcttggccgcgtcatctcggagatgagcaaggcgggcgtttcggttgcgcggatcggcgaaattctggatgcgccggtcgagcaggacgcggcggacgcacaggagtccccgatggacgggaacatcgtgttcgaccatgtgacgttccgctatgagacgggccctgacgtgctgcacgatgtgtcgttcacgatcccggcggggagcagcttcggcgtcctcggcggaaccggctccggcaagagcagtctgcttctgatgctgtgcaagctctatgcgccgagcgaagggcgcgtgacggtcggcggcgtcgaccttgcgaggatgcccgctgcgtgggtgcgcgagcatgtgggcgttgtgcttcaggagccgttcctgttttcccggacgatcgcggagaacatcggcgtctgcggcgcggacgaagcagccatccgcgaggccgcgaagacagcctgcattgcggacgacatcgagggctttgcaaacggatatgagacgatggtgggcgagcgcggcgtgacgctctccggcggacagaagcagcgcgtggccatcgcgcggatgctgacgcagaaaacgccagtgacggtgtttgacgattcgctctcggcggtcgacacgcagacggatgaaaggatccgcgcggcgctggccagagagcgcaagggtgcgacaagcatcatcatttcgcaccgcatcacaacgctgctggactgcgacaacatcctcgtgcttgaccacgggaaggtcttgcagctcggcacaccggcagagctgctccgcgtggagggcctgttccggcaaatctatgacatgcagatggccattggagaggaggcggagacatga

SEQ ID NO: 2408 - DNA, 2457 bp, Unknown
  Description of Unknown: Firmicutes sequence
atgaatcagactgccgaaggctccggcgcttcctttatggagaaggtgtcggccttcatcgttgacaaacgcagcctcatcttcctcatcaccatcatcctgctgatcttctcggccttctcgcgcaactgggtcgaggtcgagagcgacctcacctactacctgccggaggattccgaaacaaagcaggcgctgaacgtcatggacgaacagttcatcacctacggcacggcgaagatcatggtcgcaaacatcacgctggacgaggccgccgcgctgaacgacacgatcaagtccatccgcggcgtccagatggtcgactatgacgagacagaggatcattataaaaacctctccgccctctattccgtcaccttcgactattccgaggacgacgacgcctgcctcacgagcctcgacgctgtgaaggaggcgcttgcgtcctatgacgtctacgtctccaccgacctcggcaacacgcaggaggagacgatcgaccatgagatcaacatcatcatgatctatgtcgccgtcgtcatcgtcgtggtgctgctgctcacgtccgagacgtatggcgaagtccctgttctgatcctgacgttcgtggtcgcgctcgtcgtcaatcagggcacgaactatctgctcggcaagatctccttcgtgtccaactccgtcacgagcatcttacagcttgccctctccatcgactacgcgatcatcttctgcaaccacttcaaggaggagcaccgcctcttccccatccgcgaggccgtcatcgccgcgctcagcaagtccatcccggagatcggcgcgagctgcctcaccacggtcggcggcatggttgcgatgctgttcatgcagttcaagctcggcccggacatggccatctgcctcattaagtccatcgccttcgcgctgctgtcggcgttcctcgtgatgccggggctgctgatgctcttcggcccgctcatcgaccgcaccgcgcaccgcagcttcgtcccgaaggtctccttcatcggcaaatacgactatgcgacgcgcttctttgtgcccgccatcttcctgatcttcgtcgtcttcggcttcaagctctcgtcggactgcccgtatgcctacggttacagcctgctcaccacgccgaagctcaacgagacgcagatcgcggagaacatgatcgaggacaccttcccgtccacaaacatggtcgccctcgtcgtgcccgccggggattatgacaaggaacgcgccatcctcgaagagctttccacttatgacgaggtggattcctcgatgggcctgacaaacattgaggccatggacggctatatgctcgccgacaagctcacgccgcggcagttcgcagagctggccgggctggactatgaggtggccgaggtggtctacgcggcctatgccgccaatcaggagaattacggccaactggccgggaacctctccaattatcaagtcccgctcatcgacattctgctctacgcctgtgatcagatcgactcaggactcgtcacgctctcggacgagcagaccgcgatgctgaacgacgcgaaggtgcagatgaccagcgcgaagaaccagctccagggcgaggacttcagccggatgctcgtctatctgaacctgcccgtcagcggcgacgagacatatcagttcaccgacctcatgcatgagatcgccgagaaatactatcccgacggcccggtctacatcgcgggcaacagcacgaacgaatacgactttgaaaagtccttcgccgtcgacaacacggtcgtcagcatcgtctcggtgctcatcgtgctcgtcgtcctgctgttcacgttcaaatccgcgggcatgccgctgctgctgatcctcgtcattcagggcagtatctggatcaacttctccgtcccgacgatcacgggcaaatacctgttcttcctcggctatctgatcgtcagctccatccagatgggcgcgaacatcgactatgccatcgtcatcgccacgcgctatcaggagctgaagggcaagatgcaccaccgcgacgccatcgtcgagacgctgaactttgccttcccgacgatcctgacctccggctccatcctctccgtctgcggctttttgatcggcagcatgacgtccgagccggtcatcgccggcatcggcgagagcctcgggcgcggcacagtcatctcgatgttcctcgtcatgttcgtcctgccgcagatcctgctcatcggcagcggcatcgtcgacaagacgtccttctccgtgccgtccgtcgcggtcggcggacataaaaccgccaatggccgcacctatgtcaacggcatggtgtccggccgcatcaacggcacgatccgcggcgcggtacacgccgtcgtcgagggcgacatcgatctcaatctggtatccggttcagcaaatgatgaggaggcggacgatgatgaaacaaaataa

SEQ ID NO: 2409 - DNA, 1983 bp, Unknown
  Description of Unknown: Firmicutes sequence
atgaaaaaacagcaggcttacggaaatgaatccatcacgtccctcaaaggggccgaccgggtacgcaagcgcccggcggtcatattcggctcggacggcctggagggctgcgagcacgcggcgtttgagatcctctccaacgccatcgacgaggcgcgcgagggcaacggcgacacgatcatcgtcacgcagttcctcgacgactcgctcgaggtcgaggattttggccgcggctgccccgtggactggaatgaaaaggaacagaaatacaactgggaactcgtcttctgcgaactctacgccggcggcaaatacgacaacaacgcgggcggcgactatgaatactccctcggcctgaacggccttggcgcatgcgccacgcagtacgcctcggaatattttgacgccaccatccgccgcgacggcttcaagtatacgctccattttgaaaagggcgagatcgtcggcaagctgaacaaagagccggccgaccggaaaaagaccgggtcaaccttccgctggaagcccgatctcgacgtctttaccgacgtccacatcccgcacgaatactttgaggacacgctcaaacggcaggccgtcgtcaacgcgggcgtcagcttccgctatcgccgcgaaaccgagaagggcaaatttgctgagacggaataccgctatgaacacggcattctggactatgtgacggagctggccggcgaggcgccgctgacggccccgcagttctgggagaccgagcgccgcggccgcgaccgcgaggacaagccggaatacaaagtgaaaatttcagccgcattctgcttctccaatcaggtgaaccgcatcgaatattaccacaattcctcgtggctggaatacggcggcgcgccagagaaggccgtccgcaacgccttcgtctacgcgatcgacgcctatctcaaagcgcagaacaagtatacgaagtccgagtccaagatcacgttccaggacgtgcaggactgcctgattctggtgacgaactgcttctcgacacagacatcctatgagaaccagacgaaaaaggccatcacgaataaattcgtgcaagagtccatgacggagtttttccgcagccgcctccacgtctacttcattgaaaacaaggccgaggccgacaagatcgccgatcaggtgctcatcaacaaacgcagccgcgagacggcggaaaaggcgagactgaacatcaagaagaaactgaccggctcggtcgacatcgcgaaccgcgtccagaaatttgtcgactgccggacgaaggacgtctcgcgccgcgaaatttatatcgtcgagggcgacagcgcgctcggctccgtcaagctctcgcgcgacgcggaatttcagggcatcatgcccgtgcgcggcaagatcttaaactgcctgaaagcggattatgaccgcatcttcaagtccgagatcatcaccgacctcatccgcgtcctcggctgcggtgtcgaggtgcagacgaaaaaggccaaggacctcagcgcgttcgacattcaaaacctccgctggaacaaggtcgtgatctgcaccgatgccgatgtcgacggctaccagatccgcacgttgatcctgacgatgatctatcggctgtgcccgacgcttatcgagcagggctatgtctatatcgcggaatcgccgctctatgagatcggctgcaaggataagacatggtttgcctataccgagagcgagaaggcggaaattctgaaatcgctcgagggcaagaaggtcacgatcaaccgctccaagggtctcggcgagaacgaccctgagatgatgtggatgacgacgatgaaccccgccacgcggcggctcatcaaggtcatgcccgaggatatggccctgacgcagcagatgttcgatctgctcctcggcgacaacctccagggacggaaagaccatattgccgagaatggatataagtatctcgaccaattagatgtatcgtag

SEQ ID NO: 2410 - DNA, 2238 bp, Unknown
  Description of Unknown: Firmicutes sequence
atgccaaaaaagaagaacaacgaagaatctcatcataaaaacgacccgaatgtgatgggcctgcgcgccgaggtgcaggagcagccgatctgccgcacactcgaagaaaactacatgccctacgcgatgtcggtcatcgtgtctcgcgcgatcccggagatcgacggcttcaagccctcgcaccggaagctgctctacacgatgtatcagatgggtctgctgaccaagccgcgcacgaagtcggccaacatcgtcggccagacgatgaagctaaacccgcacggcgacgccgccatctacgacacgatggtgcgcctcgcgcgcggcaacgagacgctgctgcacccattcgtcgactcgaagggcaacttcggcaaggtctattcgcgcgacatggcctgcgccgcgtcccggtataccgaggcgaagctcgaaccgatctgtcaggagctgttccgcgacatcgacgccgacaccgttgacttcgtcgacaactacgacgccaccatgcaggagccgacgcttcttcccaccacgttcccgaacgtgctcgtcaacccgaacatgggcatcgcagtcggcatggcgtcgaacatctgctcgttcaatctgcgcgaggtctgccagacggccatcgctttgatcaaagatcccggcgcagacctgctcgagctgctgcccgcgcctgatttcccgaccggcggcgaaatcctctacgacgcggcgcagatgctgcaaatttacaattccggccgcggcagcttccgcatccgcgcccgctggcgctacgtcagggaagggaatctcattgagatctatgagatcccctacacgaccgcgaccgagatcatcattgacaaggtcgctgagctgatcaaggccggcaagatccgcgagatcgccgacatgcgcgacgagacggatctgaacggcctcaagctcgcgatcgacctcaagcgcggcgttgacccggagaagctcatgcagaagctcttcaagtccaccacgctcgaggacagcttcggctgcaacttcaacatcctcatcgcgggccagccgcgcgtgctgggcgtgcgtgagatcttcgaggagtggacggcatggcgcacggactgcgtccgccgccgggtctatttccaactgcaaaagaagaaggacaagctgcatctgctcaagggtctcggcaaaatcctgctcgacatcgacaaggccatcgccatcatccgcgagaccgaatccgacgcagaggtcatcccaaacctgatgatcggcttcggcatcgatcaggtgcaggccgaatacgtcgcggagatcaagctccgcaacatcaacaaggaattcctcttaaaccggattcaggagaccgactcgctcgaacgcgagatcgcagaactggaagacctcctcggctccgagcggaagatccggaacgtgatctgcaaggagctggaacaggtcgcgaagaaatacgggcaggatcgcaaaaccggcatcgtctacgaccaccagatcgccgaggcagaggaagcggacgtgccggactatccggtgacggtgttcctctcgcgtgagggctatttcaagaagatcacgccgcagtcgctgcgcatgtccggcgaacagaaattcaaggagggcgacggtctgctactcagccgcgagacgacgaacaatcaggagctgctcgtctttaccgaccgggcgcaggtctataaaacgcgcctgtccgatttcccagatggcaaggcgtctgccctcggcgactatctgcccggcaagctcggctttgacgagggagagggcttcttcgccgcagtcttccccggcgactacacgggaaatctgctcttcgtctttgaaaacggcaaggcggccaaggtggagctttccggctacgccaccaagaccaaccgccgcaagctgaccggcgcctattcggacaaaagcccgctgcgcgccgtgttccacctgacggaagaggagcagatcgcgctctacgccacggacggccgctgcctcattttctccacggcacagctcgccgtgaagaccacgcgcgccacgcagggcgtcgcggtcatgagcctgaagaaaaaagccgtgcttgaacgtgcggcgcggctcgcagagtccggcatccagaaccccgcccgctaccgcacccgcacgatccccgccgcgggcgcgctcctgcgcgaggacgatctggaagagaaacagatgacattggagctttga

SEQ ID NO: 2411 - DNA, 1656 bp, Unknown
  Description of Unknown: Firmicutes sequence
ttggcagaaaaattgaaaatcattgccctcggcggtctgaatgagatcggcaagaacatgactgtgctggaatacggcaaggacatcatcattgtcgactgcggactcggctttccggaggacgatatgtacggcgtcgacctcgtgatcgcggacatgacctatctggtcaagaatcagaaccgcatccggggtatgttcctgacgcatgggcacgaggatcacatcggcggcatcccctatgcgatgcagcagttcaagtgccccatccacgccacgcgcctgacggcggggctggtaaagctgaagctggaggagcaccatctcgaccgcgtcgtccagctccacacccatgaggcgggcgagacggtcaaggccggctgcttccaggtggagttcatccacgtgaaccactcgattgccgacgcggtcgccttcgcaatcaagacgccggtgggcatggtggtcatgaccggcgacttcaagatcgacgcaatggccgaagacggcatgatcaacctgacgcgctttggcgagctgggccgcgagggcgtcctcgccctgctctgcgactcgacgaatgtcgagcggcccggctatacgccgtcggagaaaaaggtcgccgagagcttcgagcgccagttctccggctgccgcgagcgcatcatcgtcacgacgttcgcgtccaacgccttccggctgcaaagccttctgaccgtggcgcacaagtttggccgcaaggtcgccgtcacgggccgcagcatggagaacattctcaaggtctccacagagcttggctatctgaaaattccgaacaacacgctcgtcgacatcaacacgatcaagcagctgccgaagcacaagatctgcatcgtgtcgaccggctcacagggcgaaaacatgtccgcgctctaccgcatggcgttctcggagcaccggcaggtggagattcaggcgggcgaccgcgtcatcatctcggcctcggccatccccggcaacgaaaaggccattggcaagatcatcaacgagctgtaccgcaagggcgcggacgtcgtctatgacaagctcgaggggctgcacgtctccggccacgcctgccaggaggagctgaagctcatccacggcctggtgcatccgcgcttcttcatccccgtccacggagagcagcggcatttgcaggcccattcccgcctcgcacagagcatgggcatggacccgaaaaatatcttcatcagcgacatcggtaagacgctggagctcacgcgcggcagctgcaagtggggcgcgcccgtcccggcgggccgtattctggtggacggtacgggcgtcggcgacgtcggcagcgttgtcctgcgcgaccgcaagcatctggcgcaggacggtatgctcgtcgtggtcgtgaacatctcggccgaggacggcagcgtcatcaccgggccggatatcatcacgcgcggcttcgtctacgtgaaggaatcggaaaacctgatggaagagctgcgcgtcatcgcggcccacgccatcgaccgctgccagcagcacggcaagagcgactggagcgtcctgaaggcgtcgatcaaaaacgacctctccggctatctcttcaagacgaccaagcgaaatccgatgatccttccggtcatcatggaaatttga

SEQ ID NO: 2412 - DNA, 3732 bp, Unknown
  Description of Unknown: Firmicutes sequence
aagaagatccgctacaagggcaagatctgcgaccgctgcggcgtcgaggtcacgaaggccaaggttcgccgcgagcgcatgggccacatcgagctggccgcgccgtgcagccacatctggtacttcaagggtatcccgtcccggatgggcctgctgctcgacatcagcccacgtatcctcgagaaggttctctacttcgccagctatatcgtcaccgatcccggcgactgcccgctggtcaagaaccagatcctctccgaaaaagaataccgcgacatgcgcgaaaagtatgaggacgacttcaaggccggcatgggtgccgaggccatcaaagagctgctccagcagatcaacctcgatgagctttcggagcagctgcgctccgagctgaaggacgcctccggccagaagaaactgcgcatcatcaagcgcctcgaagtggtcgaatccttccgcatgtcccacaacgatccgacgtggatggtcatggatgtgctcccggtcatcccgcccgagatccgcccgatggttcagctggacggcggccgcttcgcgacctccgacctcaacgacctctaccgccgcgtcatcaaccgcaacaaccgcctcaagcgcctgatccagctctccgcgccggatatcatcatccgcaacgagaagcgcatgcttcaggaagcggtcgacgccctgatcgacaacggccgccgcggccgcgccgtcaccggtgcgaacaaccgcgcgctcaagtccctttccgacatgctcaagggcaagcagggccgcttccgccagaacctgctcggcaagcgtgtcgactattccggccgttccgtcatcgtcgtcggcccggagctgaagctctatcagtgcggcgtgccgaaggaaatggccatcgagctgttccgcccgttcgtcatgaaaaagctggtcgaggacggccttgccaacaacatcaaatccgccaagaagatgatcgacaagggcaaggacgaggtctatgatgctctcgaagacatcatcaaggatcgcccggtcatgctcaaccgcgcgccgacgctccaccgcctcggtattcaggcgtttgagccggtgctggtcgagggccgcgcgctcaagctccatccgctctgctgcaccgcgttcaacgcggacttcgacggcgaccagatggccattcacgtgccgctgagcgccgaggcgcaggcggaggcccgtatgctgatgctctcggcgaacaacctgctccgtccgcaggacggcaagccggttacggttccgacacaggatatgatcctcggcacgtattatctgacctatcagcgctatgacgtcgatgcgttcgacacgctgcacgagatcttcccgctgctcgactgcggcaagctcgcgcccgagaagcccatctgggtcaagaacgtctgggacgatcccgagagcgaaggctatcagatgtacctgcgtacccgcggcgcgctgctcgaaaatgagaccgaccgcccggagacgatccccggctcgtatcagaccctcgaagaggctgtcaaggcgtgcgaggccggcgaggtcgcgcccgacgagaccatctatatctggaacgtctgggacaaggacgccgacatcaaggaagagaaccacatctatatccgcaccgtcggcgaatacgccaggcaggcactcgaggccggctcggtcaagccgcgcgagatcttcaagatgtaccactccgaggacgaggccatgatggcctacgccgaggggctggtcgatatgcacgacccaatcaaggtctggaaggaacttgagatcgacggcaagaaggagcaccgtgtcattgacgcgactgtgggccgcctgatcatcaacgacgccattccgcagaacctcggcttcaagaagcgcgagaccaccgacgagatgttcccgctggagatcgactttgtcgtcggcaagaagcagctcggcaagatcatcgacaattgtatccgcatcaacggcttcaccctgtcgaccgaaatgctcgacaaggtcaaggccctcggttataagtactccaccaaggcgtccatcaccgtttcgatcgccgacatggagatcccggaaaagaagtacgagatcatccacgaaaccgagcaggaggtcgtcaagatcgatcgccagttcaagcgcggcttcatcaccaacgacgaacgctatcgcctgaccgtgcagcagtgggaaaagtctatcaaggacgtcaccgatgcgctgcaaggcaatctgaagcggttcaacccgatcttcatgatggccgactccggcgcgcgcggcagcatgaaccagatccgtcagttggccggtatgcgcggcctgatggccgatacgaatggccgcaccatcgaaatcccgatcaaggccaacttccgtgaaggtctgtccgccctcgaatacttcatctcgtcccgaggcgctcgaaagggcctgaccgataccgcgctccgtaccgcggactccggttatctgacccgccgcatggtcgacgtctgccaggacgtcatcatccgcgagttcgattgcggctccacgaacggcagctggaagggcgactattatgagaagggccagctcatcgactcctttgccaaccgtatccgcggccgctatccggtctacgatatcgttgacgagaagacgggcgagctgcttcattcgaaggacgtcatgctccgcgaggaggacgccaagcgcctgtccgagcacggcatcaacaaggtctatgtccgctcggttctcggctgcaaagcccgttccggcgtgtgcgcgaagtgctacggcatgaaccttgcgacaagcgaactggtcaaccccggcgaggctgtcggcatcattgccgcgcagtccatcggcgaacccggcacgcagctgaccatgcgaaccttccacaccggcggcgtcgcgggcgacgatatcacgcagggtcttccccgcgttgaagaactcttcgaggcgcgcaagccgaagaagatggcgcagatcagcgagatcgatggcgtggtcgatgtcgacgattcgcaccgcaccgccctccgcaacatcaccatcaccgccgacgacggcgaggtcaagcagtaccaggttccgtattcggtcggcctgaaggtcgagcatggcaagcgcgtccgcaagggcgaacccatcaccgacggcgcgctgaacccgcacgacgtgctgcgcatctccggcgtggaagctgtgcaggattatctgacgcagggcgttctcgctgtgtaccgtcagcagggcgttgacatcaacgagaagcacatcgaggtcatcatccgtcagatgatgcgtaaggtgcgcgtcgaagatcccggcgataccgatctgctctccggcacggtcgtcgacgtctacgagtatgaggatgccaacgacaagatccaggcccgtatcgacgcaggcgagacggatctccgtctcgcgaccgacagcctgatcctgatgggcatcacgaaggcgtccctcgcgaccgagtcctggctgtccgccgcctccttccaggagacgacgaaggtcctgaccgacgcggccatcaagggcaaggtcgatcatctggtcggcctgaaagagaacgtcatcatcggcaagctcatccccgccggttccggcctgctggcctaccgcgatttcgagccgggcattacccccgagtccatcgtgaccgaggaaatgatcgacgacgaaaaactctga

SEQ ID NO: 2413 - DNA, 1896 bp, Unknown
  Description of Unknown: Firmicutes sequence
atggcggagtttttacccatttccaaatctgatatgaagcggcgtggctgggcgcagtgcgactttgtatacatcatcggcgacgcctacgtcgaccatccgtcgttcggccacgccatcatttcccgcgtgcttgaagacgcgggctataaagtcggcatcatcagccagccggactggaaaaacccggcgtcggtctcggcgctggggaagccgcgcctcggcttccttgtgatgggcgggaacatggactcgatggtgaaccactatgccgtctccaagcggcaccggcagaccgacgcctacacgccgggcggcgtgatgggcaagcggccggactatgccgtgacggtctactgcaacctcatccggcagacctaccgcgacgtgccggtcatcatcggcgggatcgaggcaagcctgcggcggctggcgcactacgactactggtcggataagctcaagcgctcggcgctgctggattctcaggccgaccttctgatctacggcatgggcgagcgcgcgatcgtcgaggcggcgaacgcactgaacgacggaatggacatccgcgacgtcacgtacatcgacgggacggtcttccgcacgcgcgaggtcccggacgatctgcctgcgatcacactgccgtcctatcccgcgatgcaggccgacaaatccgtctacgcgaagagcttctacctgcaataccagaacaccgacccattctcggccaagcggctcatcgagccgtacagcgaccgcgaattcgtcgtacagaatccgccgcagaagccgctctcgcaggccgagatggatcacatctacgatctgccctacacgcggacgtatcacccgagctatgaaaaggccggcggcgtgcccgcgatctcggagatcaaattcagcctgacgagctgccgcgggtgcttcggcgcgtgcaatttctgcgcgctgacgttccaccaggggcgcatcatccagacgcgctcgcatgagtcgatcgtccacgaggccgaaagcctgacgcatgagaaggacttcaagggctacatccacgacgtgggcggcccgacggcagatttccgccagccggcgtgcaaaaagcagctgacgaagggcgcatgtccgaaccggcagtgcctcttccccacgccgtgcaagaatctcgtcgccgaccacagcgactatctcgcgctgctgcggaagctgcgcaaggtgccgggcgtgaagaaggtctttatccggagcggcatccgattcgactatctgctggccgacccgtcggacgtctttttcaaggagctggtgcgctatcacatctccgggcagctgaaggtcgcgccggaacatgtgtcggacgaagtgctcaaatacatgggcaagccgcgccatgcggtctatcagcagttcgtgcggaaatatcaggagctgaaccagcgcgagcacatggatcagtacgtcgtgccgtatctgatgtcgtcgcatccgggctgcacgatggcagaggccgtgaagctggcggaatatctgcgcgacatccaccatcagccagagcaggtgcaggatttctacccgacgccgtccacgctctcgaccgtgatgtactataccggtctcgatccgcggacgatgcagctggtctacgtcccgcgcgacccgcacgagaaggcgatgcagcgggcgctgatgcaatataaagacccgaaaaattacaagctggtgcgcgaggcgctgatcctcgcggggcgggaggatctgatcggatacgggccggaatgtctcatccggccgccgcgcggcgcgggcggaacggcaaaaaagcccgccgcgccgaaaaagagcacagacagaaaagcggccccatccaaaaagaatcccgcaaaacgcggcagaagataa

SEQ ID NO: 2414 - DNA, 2424 bp, Unknown
  Description of Unknown: Firmicutes sequence
ttggagaataccgacaacatgccaaaaacgaatctggtgatcgtcgagtcgccgtcgaaggcgaagacaatcggaaaatatctggggccggagttcacggtcaaggccagcatgggccatctgcgcgatttgcagaagagcacgatgagcgtggacatcgaacacgattttgagccggaatatgttccgctcaagggcaaggaagagaccatcgaagaactacagaaggccgccgcgaaaagcgcgaatatctacctcgcaactgacccggaccgcgagggcgaggccatctcgtggcatttgaaatatctgctgaacatcccggacgacaagacgtaccgcgtgacgttcaatgaaattacgcgcgacgtggtgcgcaagtccattcaggccccgcgcgccatcgaccagaatctcgtcgacgcgcagcaggcgcggcgcgtgctcgaccgcatcgtcggctatcagctcagccccctgctctggaagaagatccgcaagggcctgtccgccgggcgcgtgcagtcggtggcgacgcggctgattgtcgaccgggagaacgagatccgcgccttccagccgcaggaatactggtcgctggatgtgaacctggcccgcgtgggcaagcccggcagctttgtggcgcactattatggagacccgaagaagcgcgagctgccgaaccgcgaaacggtcgacgcgatcttggccgagctgaagaccggcgaattccgcgtggagagcatcaagaacactgagaagaagaagaatcccgcgccgccgttcatcacgtcgacgctccagcaggaggcgtcccgcaagttcaacatgacgccgcggcgcacgatgatgatcgcgcagcagctctatgaaggtgtggagatcacgggcgaaggctcggttggtctgatcacatatatgagaaccgactcgctgcgcatctcggaggaggcgctggccgcggcggcggatgtgatcaaaagccgctatggcgcggcctattatccgggcagcccgcggcgctataagccgaagtccggcgcgcaggatgcgcacgaggccatccggccgagtcatgtggagctgacgccggagatggtggagcacgacctgacgaaggaccagttccggctctataagctgatctggagccgctttttgtcgtcgcagatggcgagcgccgtctatgacgtgacggccatcgagtccagctgcggaaagcacctgttccgcgcgagccatcagagtatgcgcttttccggcttcacggccatctatgaggagggccgcgacgacgagcaggagaagctggattcgccgctgcccgacctgaacgagggcgaggcgctgacgccgacgcagtatgacccgcagcagcatttcacgcagccgcccgcgcgctacaccgaggcgacgctcgtgcgcgcgatggaggaaaagggcgtgggccgtccttcgacctacgcggccatcatcgcgaccattcaggaccgcgaatacgtctcaaagacggacaagcgcctggccccgacgccgctcggcgaggtggtcaacgggctgatggtggagcggttttcggatattgtcaacgtggagttcacggcggacatggaaaagcagctcgaccgcgtggaggaagggcagctctactggaaggaagtcctgcggaagttctacggcggcttccatcaggagatgctggacgcggagcaggcgctcgacggcgtgcggctgaaggtgccggatgaggtgacagacgagaagtgtgagctttgcgggcggaacctcgtcgtaaagacgagccgcttcggcaaattccttgcctgcccgggctatcccgagtgcaagttcacgaagcccatcaccgagaagatgccgggccgctgcccgaagtgcggcagtgcgattttgaagcggaagtcgaagcgcggctacgcctattacgcctgtgagcgcggcgccgaatgcggctttatgacgtgggacgtgccgaccgatcaggattgcccggtctgtggacagacaatgttcaagcgctctgggcgcggcgcgatgaagccgttctgcatcaacccggagtgcgagaacttcctgccggaggacaagcgcggctatcgtcggaaggcatcctcgaccggcgcggcgaccgccgagagcaatgcggaggcggcagccgaggccgagcaggagattttgaccgagaaaaaggcaaaatccgctgcgaagaaggccgaaaaggccgaaaagaccgcggaaaagaagcccgccgcgaagaagtccacagcgtcgaaagcggacgccaaaaaaccggcggcgaagaaacctgccgcaaagagcacggcggcgaagaagcccgctgcgacgaagacgacaaccaccaggacgaccgccgcgaggaagacggcgaagaaggatacggaatga

SEQ ID NO: 2415 - DNA, 2163 bp, Unknown
  Description of Unknown: Firmicutes sequence
atgggtcttccggcgaagctggttcgcgcacaactgcatattatgaagcccatcgcggcaaatctctcgcttgaggccacgcgcaaggggcaggacaagctcggcgagatcatggaggccatccaccggcgcgacgtgttcgagcgggagcacgattttggcgcgtttcagggcgcgtggctcatgccgaaggacgagcggcggcagggggtcatcctctatctgcacggcggcggctatacttgcgggagtctggagtatgcgaagggcttcgccgcgacgctggccgacgagtgcggcgtgcgcgtgttctgcgcggcctaccgtctcgcgccggagcaccgctatcccgccgcgctggacgacgcgctggaggcctaccggtatctgctgaaaaagggctatccggcccggcagatcctgctctgcggcgagagcgcgggcggcggactgatttacgcgctctgcctgcggctgcgggcggagaagctgccgctgccgtgcggcctgatcgccatttcgccgtggagcgacctgacgcagagcggggagagctatgtcacgaaccgggacgtcgacccctcgatgacgaaggagctgctcgacttctacgcgaaatgctacgctgacgatcccgcgattccgtactgctcgccgctgttcggcgatctgcgcggctttccgccgtcgctgctctttgtgggcggggatgaggtcatgctcgatgacacgcggcggctgcatgccgcgctgcaaaaggccgggtgcgacagtcagatggtcattgcgccggagcggtggcacgcctacgtgctctattatctgagcgaaaacatgtcggacttcgatacgatcaacacatttttgacgcgggtgttgtccccggcgaaaaagctccgctggatgcgcctcgacaatgcggcgaaaatttacccggcggccaagcggcgcggatggacgaactatttccgcctctccgccacgctgaatgagccggtcgacacgaagatcctcgcggcggcgctggatgtgacggtgcggcgattcccgtcgattgcggtgcggctgcggcgcggtgcgttctggtactatcttgaacagatcccaaaggcgccgcccattgaggaggaccggagctatccgctcgtccacgtcccgttcgacgatgtgcgaaagtgcgcgtttcgcgtgctggtctatcatgaacgcatcgcggtcgagttcttccacgcggtcaccgacggcacgggcgggatgatcttcctgaaaacgctcgtggcggaatatctctgccagcggtacggcatttccatcccggcggagcacggcgtgctgggccggctggaggacccgagcgaggaggagatggaggacagctttttgcgctatgcgggcaacgtccacgcgagccgcaaagagtccacggcctatcagctctccggtacgttagagccggatggatttttgaatctgacgacgctgatggtgccggtggacgctgtgcgcaagtgcgcgaaggagcaccacgtcagcgtgacggagctgctcgcggcggcgatgatgaaggccatctgcgagcttcaggcggagcagacgccccgcaggcggcaccgcaagccggtgaaggtgctgctgccggtcaatctgcggcagatgttccccagccggacgctgcggaacttcgcctcctatgtcacgccggagatcgatccgcggctcggcgattacacgttcgacgagatctgccgcgtggttcactaccggatggggctggagaacgacccgcggatgatgggcgcgaagatcgcgaccaacgtcgcgagcgaacgttcgcccgtgctgcgggtaatgccgctgttcatcaagaatgcggcgatgcgcgtggtgttcgacatggtgggcgagatcaaatcctgcctgtgcctgtccaacctcgggcgcgtggagctgccggaggcgatggccccgtatgtcgagcggatggactttatcatcggcgtcccggcgaaggcgcactataactgcggcgttgtctcgtggaacgggacgatgaacgtcaattttatccgcaacgtgcgtgagccggagctggaatctcatttttaccgcgtactgcaccggctgggtctccccgtgaaggcggagagcaaccagcgccggtga

SEQ ID NO: 2416 - DNA, 1545 bp, Unknown
  Description of Unknown: Firmicutes sequence
atgacagccttggaaactgtttgcgcgattgaattgagacacatcaccaagcgttttggctctgttgtcgccaacgacgggatcgacctgacgatcaattacggcgagattctgtccctgctcggcgaaaacggcagcggcaagaccacgctgatgaatatgctcgcaggcatctacttccccgacgacggcgagatcctgatcggcggaaagccggtctcgatccgcagcccgaaggacgcattcgacaacaagatcggcatgatccaccagcactacaagctgatcgacgtattcaccgccgcggaaaatatcgtccttggactccacgaggggcagaagctcgatatggctgcgaccaacaaacgggtgcaggagatctgcgaccggtacggattcgacatcgacccgacccagaagatctacgacatgtccgtctcgcagaagcagaccgttgagatcgtcaaggttctctaccgcggggccgacgtcctgattttggacgagccgaccgctgttttgaccccgcaggagacggacaagctcttccaggtgctgcgcaacatgcgcgccgacggcaaggccatcattattatcacccacaagctgcacgaggtcatggccctgtccgacaaggtcgccgtcctccgcaagggcaagtacattggcacggtcaacaccgcggagacgaacccgcaggccctgaccgacatgatggttggccgcgcggtcgccctgaacatcgaccggcccaggtatgaaaatcccgtgccgcgcctcgcggtgcagcacctcacgtgtcttgacgccgagggcgtgaagaagctcgacgacgtgacgtttaccgccatgggcggcgagatcctcggcatcgcgggcatcgccggctccggtcagaaggagctgctcgaggccatcgcgggcctgcatcccgcggtctccggcgcgtccatcgtctataccccggtcgacggccagccgcgcgagatcatcggcaaaacgccgatgcagatcaaaaaggcgggcgtcgcccttgccttcgtcccggaagaccggctcggcatgggcttggtcggctccatgggcatgacgggcaacatgatgctccgctcctggcgcaagggcaagagcgcctttgtcaaccgtaaggatccgaacgagctggccttgcaggtctggaaagagctggaggttgtcacgccgagcgcggactatcctgtccggcggctgtccggcggcaacgtgcagaaggtgcttgtcggccgtgagatcgcgtccagcccctcggtgctcatgagcgcctacgccgtgcgtggactcgacatcaatacctcctataccatctacaacctcatgaccgaacagaagatgcgcggcgcagccgtcatctatgtcggtgaggatctcgatgtgctgctcgaactctgcgaccggatcctcgtcctctgcggcggcaaggtgtccggcatcgtggacggaagggccgttacgaaggaagaaatcggtctgatgatgaccaaggtcggcgggaaggaggaagcataa

SEQ ID NO: 2417 - DNA, 4614 bp, Unknown
  Description of Unknown: Firmicutes sequence
atgaaactcaaacgaatcatctcggcattgcttttactcgcaatgctcctctcctgcctcccattcaccgcgatggctgtggaaggcgaaaatgatttctatttctcggcagaaacgtccgaagcgctccttgtttctccgcgaaaaattccctattccgacgggcagacgatctccgaggcactggccgatgccgggatctctctgaccttcgacagcggcagcagcttcgtcaccgccatcaacggcgtctccggcaaatacctctattgcggagatttttcgactgaacaggggctggctctgcccgcaggctcggtgcattatctgttttttaccgaagatctcactgcggcactgacggatgggcgaaaagcgctgatgcgcgccatggcggactatcttgccgaagatcccgacgtgcagaacgccgcaaaaacgccctatcaggcagcatccgccgcctaccccggcatctcagacgcagacgcgcagcgctgcgcggacgcaatcaccacagccatcgcagaataccgcgccagtctgactggcggctatgagatcaccttttccggctatacgggcggaaattatgaggtttacgctgaaaacaaattcggaaaacgctttacggacacaggccatcccggcgttcttacgctcccgatgggcgatggctacaccttctgcatccgtcagggcatccgccaggtctccggcgcactgaacgtcagcggaccggcgacgatccaggccgcgctcccagcctcggatgactggttcaacgaaacggcgttccagatctccgccgaaagcggcaatgatttcaaggcgatagcctgtacgatccgtgaccacacagtggcggtcctcgttccagacgttctctccggcgatctgtgcccctatatcgagctgaacaagccgtatacgaaggccgcgacggtcacggccctctattccgacgccagcggaaagccgcaggagaagatcatcccggaattcgtcaaaacaaccagccttccgaacgtgctttcccgcggcgcggcgggcaatactgtcatcctccgcgcaagcataacggggacagacggctatgaccagagcgtcgacctgaccctgcggctcgaccggatgccgacgctggcctctctccgcgtgacgaacgcagccgagaccgcgcaggccgcagacaaggcgttctccccgacggatacggaatacacctaccagatcgtcgacaccgccaaagagctgcgaatctatcccacggcgacgcttacgggcagcagcataaccatctcctccaacgaaacagattacccgctcgacgaaaagggaggcgcagccgtgccggtcaacgggaacaccgacgtcaccgtctcggtgaaaaacggcgcatatgagacggcctataccctgcacatccagcccgtcaaggggcaaagcgtcaagctcatcctgaaggacgcggacgagcttgaggtgcggaacaaaaacggcgaggttctggcctatacctcggttcaggagcttgggaaaccggtctatacctacacactggtcccgaacgaaacctacagctacgtggcaacgaagaacacctggtatcacgcgaagaaggactttacgctcagcgacgtgggcagcggcctgaccatggccgtcgaggtgacggccggagactggctgaccgagctgacgcttgacgtgccgtttgacggcggcacgagcttcacgccagcgcagcacacctattccgccacatactgggacgccacggtgacgccctctgcgcgggccgcgcagcagaacgaggacggagattccctcggccctgtctgtgtgatttaccccacacagagcacaaagcagcccgagacgccgcagcagatcgatttaagctccgggaaaagcgcccatctgaactgggccgtgctgaacggcagcgcccacgagaatacgctcaccttccgtgcctcgcgctatgacgcggcaacgaagatcaccagctatacggactatcaggtgacgctgaaacggtcgctcagcctcgagagcctgtccgcctcggcaaacggcgtatccgtgccgctccgctatcaaaccgcctccggcacgcaggcagagggctataaagccacgcaatcagactataccgtgctcgtcccggcggcagcacgctcgctggatctgaagctccaggcgcacggaaaactgccaaaatacggcgacgaagacgtgggctatctcgtggacgggacgccgctcccagaggatcaaacctcgtccacaaggccggtatacgagctgtctctgccgctgaacggcagcggcagcaccgagacgctccgcttcacgctgacgaaccggcacaacgagaccgcgaaaacggtctataccatcaccgtccagaaggcggcggcaaccagcgtccgcttccaaaccacgccgaaggacgcgctgatctgcgtcatagaatcgggcagcaatcagcgcgtctggccggaggacggcgtcttcgcgctctccgagggctttacccatctctattcgatcaccagtccgggctatatcgggcagggcggcgagatgacgctcagcacggaaaacggcgtgcagaagctgaccatgggcggcaaaacatactccgatctcagcaacgtcgccatttccttgcagacagcgcagaaaaacacaacgctggacaccacactgagcgccgaatgggcagatttccgtggaacggcctatgtaaaaggccagatggccgcgggcggcaaccgcaacaacgccgtcacagacgcgcccacgcccatctccgcggcggaaggcacgctctactgggccgtccatctcggctcctcggccaccggcagcggcagcatgggcggcggctcggtcagcaatccgatcctcgtgaacgacgagctgattgtctacgccggaagtacgctctaccgcatcaacaaggacacgggcgaaacgatcaaaaccgggaaaatggccggttcgtccagcttctccatcaacggcccgacctatgcggacggcatgatcttcgtcgcactgacgaacggcgtggtgcaggcgttcgacgccgactcgctggaatccctctggatctaccatgacccgctcaagggccagccgaactgccccattaccgtctcaaacggctatgcctataccggcttctggaacagtgagacccgcgacgccagcttcgtctgcctccccatcgcggacgagcggccaactgccagcaatgaagaaaaatatgccgcctggcggcacgtgcagaccggcggcttctactgggcgggcgcatgcgtccaaaacggcgtcctcctcgtgggcacggacgacggccaggactcgacctcgccggtgctgtcgaccggccgcgtgctgctgttcgacgcggccacgggtgcgctgctggacgaagtgggcggcatctgcggcgacgtgcgcagcaccatctgctatgacagcggcagcaaggcctactatgcgaccagcaagggcggcgaattcatccggatcaagctgaacgcgacggggcggaagatcgactcgaagcagacgctcaagctgcaaaacggcacaaccagtgtcgccatgagcacctcgacgcccgtcgtctacaaggggcgggcctatgtcggcgtctccggcagcagccaattttatgcgtattccggccataacatcacggtgatcgaccttgacggcgcaatgtccatcgcctaccgcgtacccacaaagggctatccgcaggcgtccggtctgctcacaacggcgtatgaaaacgacgagaacggcggcgtctacgtatacttcgcagagaacaccatccccggcacgatccgcctcctgtacgaccggaaggggcagacgagcccggcgctgaccacgatggaatccggaaagaaggtggcctatgccctgttctccccgagcagcggccacgcggagcattgcatttgcagcctgatcgcggacgcagagggcacgatctacttcaaaaacgactccggccatctgatggcctatggccgtatgctggagggcatggagatcaaaacgcagcccacaaagacggcctatgcgccgggcgagacgttcgacacggcgggtctgaccgtggtgggcgatttcgggcgcggcgtgaagcgcaacgtgacggcatatctgatccccccggcagacgccattcaggcgggcgatacctccgtcacgctcaaatacggcaagggcctgaccatgtaccagaatcagcccgacggaaacggcggcatggtgagcaacctgacaacatccccgacgctgaaggtggacatccgcgtagacagcgggcagacggacggcaagatcggtgacatcacatggcactggaagtccaccactggcgttctgaccgtggacacgatcccggacggacagacgctgatcgcggcgtgctatgacgcgaacggccgggtaacaaaggcactgccgctgacggcaggcacgaatgatctggccaaggacagcgcgcagatcaagctcttcctgctggacagcaagctcgcgccgctctgcgatgcaaaactggtgataaaggagtaa

SEQ ID NO: 2418 - DNA, 1341 bp, Unknown
  Description of Unknown: Firmicutes sequence
atgacaaaaggaagcccatggaagctgatcgcgggatttgcgctccccgtgctgctgagccagatcttccagcagctctataacacggcggacacgctgatcgtcgggcgttatctcggcgacgaggcgctcgccgccgtcagctcgtctggcccgctgattttcctgctcatcagctttttcgagggcctgaccatgggcgcgagcgtgacgatctcgcgctatttcggcgcgggcgaccatgaccgcgtacagcgcgccatccatacgaacatcctcgtcagcacgtgcagcggcatttttctgacgggcttcggtatcatcatgacgccgcagatcctgcgctggatgggcacggatccggaagtcctgccggacgcgatctcgtatttccgctattatttcacaggtgtgctggccgtggtgctctacaacgcgtgcaagagcatcatgaacgccctcggcgacagccgtcggccgctctactatctgatgctgtcctcagcgatcaacatcgtgctggacattctgttcatcggtgggttccactggggtgtctggtctgccgccgtcgcaacgacgatctcacaggccatcagcatgatcctctgcctgatccatctttccaaaaagacgacggcgttccacatcgtctggcgggagctgcgctttgatcgcgagatgttcggtcagatcgtgcgctacggtctgccgtccggcgtgcagaattcggtcatcgggctggcaaacgtcatcgtccagtcgaacatcaactccttcggcaagatcgccatggcagcctacggcacctacgccaagctggagggcttcgctttcctgccgatcacgagcttcaccatggccctgaccacctatacgagccagaacctcggcgcgggcgaacacgcgcgggcgaaaaaaggcgcacggttcggcatcctgtgctcgatcacgctggcagagctgatcggcgtggccatgtggatcctgatgccgcagctggcatcgctgttcagtcagacgccggaggtcatcgcgctggccacgaagcaggcacggacgatctcgctgttctatttcctgctggcctattcgcacgcgatcgcgtcgatctgccgcggcgcgggcaaggcgttcgtgccgatgatgatcatgctgagcgtctggtgcgtgttccgcattctctatatcacgacggtcatgcacatctcgcgcgatatccagctcatctattgggcctatcccatcacgtggtcgatcagctcggtcatctacttcatctattatcataagtcgaactggatccacggcttcgaccgcgaaacgcagaaagctgcataa

SEQ ID NO: 2419 - DNA, 1383 bp, Unknown
  Description of Unknown: Firmicutes sequence
atgggagaaagaattccggaaaacaagatggggacgatgccggtcggcaagctgctggccgatatggcgatcccgatgatgatctcgatgctggtgcaggcgctctacaacgtggtggacagcgtgttcgtctcgcgcatcagtgaaaacgcattgaatgccgtgtcgctggcgttcccgctgcaaaacctgatgattgcctttggctccggcacggcagtcggcatgaacgcgctgctctcgcgctcactcggagcgaagcagcaggagcaggtcgaccgcgcggccaatacgggcatgttcctgttcggctgcacctacgtgctgttcgcgctgatcggcgcgtttttgtcccgtccgttcttcctcgcgcagacacacgacgcggagatcgtgggctacggcgtggactatgcgtcgatctgcctgatcttctcgttcggcatcttcgcgcagttctgcttcgagcggctgctgcaatccacaggccggacaaagctctcgatgatgacgcagctgatcggcgcggtcatcaacatcgtgctcgacccgatcctgattttcggctggttcggcctgccgcggctcgaggtcaaaggcgccgccatcgcgaccgtcgccgggcagatcatcgcggccatcatcggcctgttcgtcaacctgaagaaaaatcccgaaattcacatccgcgcgaagctcgtccgctggcacggcgcgacggcgggcgaaatttaccgcgtgggcgtgccgtcgatcatcatgggttcgattggctcggtcatgacgttcggcatgaacaagatcctcatcgccttcaccacgacggcgacggcggtcttcggcgcgtatttcaaattgcagagtttcatcttcatgccggtctttggtctgaacaacgcgatggtgccgatcctgtcctataactacggcgcacgcaagccggagcgcgtgaagaaaacggtcaagctcagcatcttcacggccatcggcatcatgatcctgggctttgcggcctttgaactgatccccgatgtgctgctggagctgttcgacgcgtcggagacgatgctctccatcggcacgacggcgctgcgcatcatcggcacgcactttttgatcgcgggcatcaacgtcgtcgccatgtcggtctatcaggccgtcggcgatccgctctattcgctgctcagctcggtaacgcggcagctggtggtgctgctgccggcggcgtggctgctggcgcggacggggcggctggagctggtttggctcgcgttcccgattgcggagctggccgcgcttgcaatgagcgccattttcctgcgcaagacgctccgcacggcggagtgccgcatggccgacgatgactccggcgaagttgtttag

SEQ ID NO: 2420 - DNA, 1413 bp, Unknown
  Description of Unknown: Firmicutes sequence
atgatgaaaaacagtgaaaagacgatggataagatcatcgcgctctgcaaaaaccgcggcttcgtgttcgccggatctgaaatttacggcggcctcgccaacagctgggactatggcccgcttggcgtggagttcaagaacaatgtgaaaaaggcatggctgaaaaagttcgtgcaggaaagcccgtacaacgtcggcctcgacgcggccattatcatgaatccgcagacgtggatcacgaccggccacgtgtccagcttctccgacccgctgctcgactgcaaggcctgcaaggcccgccaccgcgcggacaagctcatcggcgaggagcatcatgaggtcaatgtcgacgcgatgagcttcgacgagatggacaagttcattgccgagcacgaagatattgtatgccccgtctgcggcaagcatgacttcacgcccatccgcaagtttaacctgatgttcaagaccgccatcggcgtcaccgaggactcgtcctcgacctgctatctccgcccggagaccgcgcagggcatcttcgtgaactttgccaacatccagcgtaccacgcgccgcaagctgccgttcggcgtctgccaggtcggcaaggcgttccgcaacgagatcacgccgggcaacttcacgttccgtacccgcgagttcgagcagatggaatgtgagttcttctgcaagccgggcaccgacctcgagtggttcgcctactggaaggagtactgcgtcaactggctgaaatccctcggcatccatgaagagaatctccgcctgcgcgaccacgaacccgctgaattggcgttctattcccgcgccacgacggacatcgaatatgcgttcccgttcaccgattggggcgaactgtggggcattgccgaccgtaccgactatgacctgaagcgtcatcaggaggcgtccggcaaggatctgacctacttcgatcaggagacgaacgagcactatatcccctacgtcatcgagccgtccctcggctgcgaccgcgtggcgctcgcgttcctctgcgaagcgtatgacgaagaggtcatcgacgcggagaagaacgacgtgcgcgtcgtgctgcacctgcatccggcgctcgcaccttataaggcggccatcctgccgctgagcaagaagctggccgagccggcgaagaagctcttccaggatctctgccccgacttcatgctcgactacgacgagaccggctccatcggcaagcgctatcgccgcgaggacgagatcggcacgccgtactgcatcacggtcgacttcgccaccgtcggcgacgagaagactccggcggacaacgccgtcaccatccgtgaccgtgacactatggaacaggtgcgcgtgccgatcgcggagctgaagacctggctcgccgagcatacgaaattttga

SEQ ID NO: 2421 - DNA, 1731 bp, Unknown
  Description of Unknown: Firmicutes sequence
atgaagatggtcatgatcatggtcatcctcattctggcgctgatgacggtgatcggagcgtttctgatcagcggcgtcggcaatttctacatttcggaattctatgtacagatggagcggacgttctcgccggagttcatcacgcagctgcaagatctggcggacggcgaaaatgggccgacgcagatgaaagaactgctgatggcgcagacaggactcggcatcgacgtgaacgaccggaacgtctatattttagacagcctcggacaggtgctcgagggttcggatgagcggacacaggtgagcgtgtcgcagaatctgctgacggcgatgaacggcgaagtcgggcaggacggatcggtcacgggtgaattcatggatctggctgtgcccatcgtgacggatgagcattcgtacatcgcgtacatctacgacaaccgcgcgacggtcgatgcgctgacgagcgaactgatgagcattatcctgcgtgcgctgggccttggcctggtgatctgcgtggtgctctcgttcctgctcgcgcgcatcctcatcacacccattcaggcgctcaccgtcggcacgcggcaggtcgccgcaggcgacttttcgcagcgtgtggccgtcgagggccacgacgagatcggcgtgctcgcgcggaacttcaaccacatggcaaaggtcctcgaggacacgatctccgaggccgagaacgagcgcaacaagctctccacgctgtttttgcacatgaccgacggcgtcatcgccttctcggtctccggcgcgctgatccactgcaacccggcggcgagccagatgctcgcgcgcgggctggactccacgacgacgttcgatgaactcttcggacaggaggcggagctggacacgctgctgacgctgcgccgcccgcaatatttagagttacagaagaccgcgggcgaccgcgagctggagctgttcatggccccgttctcgtccgaccagacgcagggcggcgtccttgtcgtcatccacgatgtcaccgagcagcgcaaatccgagcagtcgaagcgtgagtttgtcgcgaacgtctcgcacgagctgcgcacaccgctgacgaacatcaaggcctacgccgagacgatcatcagctccggcgacgatctgccgggcgagctgcggagcaacttcctcgccgtcatcgtcagcgaggccgaccgtatgacccgcatcgtgcaggatctgctgacgctcagcaaaatcgactacggcaagatggaaatgaacatctcgcgcttctcattccgcaaggcggtggagaacgtgtacgaggcggcgaagctcaacgccgagcagaaccaccaccataccatgaccctcaccgaggaggacgacatcccggacgtcaacggcgaccgcgagcgcatcgagcaggtggtcacgaacatcgtgtccaacgcggtaaaatatacgcctgacggcggaaaaattgagatccatgtcggaaagagcggaaaaaatgtctatgtccgcgtctcggacaacggcatcggcatcccggagaaggatctgccccgcctgttcgaccggttctaccgcgtcgacaaggcgcgctcgcgcgagtcgggcggcacgggcctaggcctgtccatcgcgcaggagattttgaagcagcataagggcacgatccgcatcgattcggtctacggcgagggcaccgatgtccgcatcaccctccccgctgctgagagttaa

SEQ ID NO: 2422 - DNA, 2064 bp, Unknown
  Description of Unknown: Firmicutes sequence
atggcctatactgccaacgacatccgcaacatcagcctgctgggacacggcggcgacggcaagtccgccctgtgcgagagcatgctgttcaccaccaaggcgatcacccgtctcggcaaacgcgccgacggcacgaccgtttccgactttgacgacgaagagaagaagagacagtattccatctcctcgtccatcattccggtggaatataacaagtgcaagctgaactttatcgacaaccccggctatttcgactttgccggtcagatcgcgcagtcgctgcgcgtggcggacgcaggactcatctgcctcaccgccaagggcggtatcgccgtcggcaccgaaaagggctggaagagcctcgccaaggccggcctgcccgcgatgttctacatctccaagctcgacgaagagcatgccaacttcttcaacgtgttcgactctctgcgtgagatgttcggcgcgtccgtcatccccttcacgttcccgatcatgaacggcgacaaggctgtcggcgtggtcgacctggtcacgaagaaggcgtacgacgaagccggcaaagagatcgccctgcccgccgatgcggccgacaagatcgaagaatacatggccgagctgaacgagcaggtcgccgagaccgacgaagccctcatggagaagttcttcatggaagagccgttcaccgaagaagagctgctcaccggcatcaaggccggcattcgtactcggagcgtcacgcccgttttctgtggctgcgcctataccggcctcggcaccacgaacctgctgaccaatctcgtcaagttcgcgccgaaccccctcgagggcaagcctatgacccagatcgtcgatggcgaagagaaggaattcaagctcgacccgcacggcagccccatggctttcgtcttccacaccatgtccgaccagtacggcaagaactcctacttcaaggtcatctccggcgacgtcgaggacaccatgaccgtccagaacgtccgcaccggcgactctgaaaagctcggcaacatgttcttcccgaagggcaaggacaacgctaagacctccaaggtctgctgcggcgacatcggcgtcttcaccaagctcgcctccgtcaagaacggcgataccctcggcatgccgggcaagactgtccagatcaagggcatgagctacgacgagccgatgtacaagatggccatctacgccaaggtcaagggcaccgaggataagatcgcggccggtctcgtcaagctgaacgaggaagactcctccttcacctatggcaacgaccccgaaaccaaggaactcatcatcgcgggcgctggcgacatgcagctctccgtcctgatggccaagctccagagcaagtacaaggtcgaggccgtgctcaagcccgccaagatcgcctaccgtgaaaccatcaagaagaaggtcgagatccacggccgtcacaagaagcagtccggcggccacggccagttcggtgatgtctatatccgcttcgagccgcagtccgagtccgaagagatgatcttcgcggacgagaccgtcggcggctgcgtgccgaagaacttcatcccgtccgttgaaaagggcctgcgcaactgcgtcggcaagggcgtcctcgccggttatccggtcgtcttcctgaaggccacgctgtactttggttcctatcatccggtcgactcctccgatatggcgttccagaccgctgctggcatcgcctataaggaaggtcttcccaccgctggcccgaccctgctcgagccgatcggcgagctgaaggttctcatccccgatgccaacatgggcgacgtcatcggcgacctcaacaagcgccgcggccgtgtcatgggcatgaaccccgatcccgagaaccccggctatcagatcgtcgaggcggaagtcccgatgggcgagatgaccagctataccatcgacctgcgcgcgatgagccagggccgcggcagctacacgctgaagttcgtccgctacgaggaagtcccgcagatgaaccaggccaagatcatcgaagacgccaagaaggaagaggaagaataa

SEQ ID NO: 2423 - DNA, 1842 bp, Unknown
  Description of Unknown: Firmicutes sequence
atgtactgtgtgaaaaaaatgaccgaggatctctactgggttggcggcaacgaccggcggctggcgctgttcgaaaacgtctatcccatcccgcgcggcgtgagctacaatgcctacgtcgttctggacgaaaagaccgtcctgctcgacacggtcgacaactccgtctcgcccatcttctttgaaaatctggcgcacgtgctgaacggccgcaagctggactatctcattgtcaaccacatggagccggaccacgccgccacgatcgaggccgtcgtgctccgctatccagaggtcacgctcgtctgcaataagaagaccgcgcagatgatgaagaacttcttctccttcgacgtcgacagccgcgttcacctcgtcgccgagatggatacgctctgcaccggcaaacacaccttcgcgttcgtcatggccccgatggtacactggcccgaggtcatggtgacctatgatgccacgacgaagaccctcttcgccgccgacgccttcggcacgttcggtgcgctgggcggcaacctctacgccgacgaagtcaacttccagaccgagtggctcgacgacgcgcggcgctactataccaacatcgtcggcaaatacggcacacaggtacaggctctgctgaaaaaggccgcgacgatcgagatcgagacgatctgcccgctgcacggcccggtctggcgcaaggacatcggctggttcatcgacaaatacgtccactgggcgacctatacgcccgaagaggacgccgtcgtcatcgcctacgcctccgtctacggcaacaccgagactgccgcgaacattctggccgggaagctggccgacctcggcgtccgcaacgtcaaggtctacgacgtctccgcgacgcatgcgagcgagatcgtctccgaatgcttccgtgcgagccaccttgtcttcctctccacgacgtacaacgcgggcatgttcgtgaacatggaaaatctcgtccacgacatcgtcaaccacaacctccagaaccgcaccatcgccctcgtcgaaaatggctcctgggcgccgacggcgggcggcctgatgcgtgcagagttctcgaagctgaaaaactgcacgatcctcgacgagacggtcaccatcaagtccagcctcaaggaagcccagctcgagtcgatggacgcgctggccgaggctatcgtggactccatgccgaagcacgaggccccggtacacaccgcggacgccccggtcgagcagaacgcgatgttctccctgtcctacggcctgttcgtcctgacggcccgcgacggcgcaaaggacaacggctgcatcatcaacactgtcacgcagctgaccgatacccccaagcgcatctccatcgccgtcaacaaggcgaattatacgcacgacatgatcaaaaagaccggggtattcaacgtctccgttctctcgaacgacgcgccgtttgcgatgttccagcactatggcttccagtccggccgcgacgtcgacaagtttgccggcgtgcagggcatggcccgcgcgaccaacggtgtctactatctgccgtactgcacgaacgcctttatctcggccagggtcacgcagaccatcgagtttgagacgcacacgctcttcattgccgatgtcaccgaggcgcggcagctctccgacgtgccgtccatgacctacgcctactatttcgctaatgtcaagccgaagccctccaagctcaaggagcagcacggctgggtctgcaagatctgcggctacgtctacgagggcgaggagcttcccgcagacttcatctgcccgctctgcaagcacggcgccgaggattttgaaaaagtttga

SEQ ID NO: 2424 - DNA, 1551 bp, Unknown
  Description of Unknown: Firmicutes sequence
atgaaaaaacgcatttcgctcctgctcgtcctgctcctgctcgtctccgcgctgacgcctgccgcgcttgccgccgacgatgcagataccaccgaggccgttccggctgcacccgaacagctcgccgccgaggccctgtccacgatcggcgttttccgcggaactggcaatggctttgcgctcgaccgcgcgccgacgcgcctcgaagccgctgccatgctcgtccgtctctacggcgcggaggaggcggcacagaccgcttttgaaaacggcgagatcagccatccatttaccgacgtctccggctgggccgagccgtatatcgcctggctctacgccaacagcctgacgcgcggcgtcggcgagaatacctttggctccacacgctcctgctccgcacagaactatgcggtgttcctgctccgcgccctcggctatgcagacggcgaggactttacatacgcggacgcgctggcctttgcggcagactgcggcgtgtataccgacggcctgttttccggaacctttacgcgcggcgatctcgcgctgatgacgtggttcgcgctgttctgcaagtgcaaagagggcggcacgatgcttctccagagcctcgtgaacgcgaaggccgtcgacgccgacgcagcgcgaaagctgcaaaatcagtatcaaaacgacggcgtgtccctctcaaaggacggcctgctgatcgcgtcctccaagtggcagtccgccttgcaggagctgaccatcacggtcaacatcgccagcaactcgcccacgctcgcgggcgacacgatcacgctcgacaaggaggcgctcaccgcgctggctgagaacgacggcacgggccgtgtcctgatttcgacggcgtcgctgcgcacgctggccgagggctggagcgagacctatggcgtgaaaaacgggccgttcctgttcgagtcctacgtcaagggctggacggagatcgactttttgacctgcgattataagctggacacggatgccgccgtcaaggagctgctccatcagctgctgctccggcagtccggcgagatcgacgcgccgctgaactgctaccggaacggcaagctgttctccatcggcgatacctatgtcgaggtcgattttgacaaccagcagctgacgttcttcaagcatggccagatggtgctcaattcgaacgtcgtcaccggtaagctcgacggccatcagacgccggtcggactttactattcgcataacaagcagaccaactgtgtccttgtcggtccggatttccgtgtgttcgtcaactactggatcagcatcatctatgacgtcatcggcttccacgacgcctcgtggcgctcggtcttcggcggggagtattacgtcaatgacggctcgcacggctgcatcaatacgccggacgccgcgatgaagtatctgttctataacttggacgataacacaccggtgctgatgtatggccgcaatacgtggtacgatgtgaacgacccgtctgcctcgccggtcacaaaggatcccatccacggacagaccgcaaaataa

SEQ ID NO: 2425 - DNA, 2535 bp, Unknown
  Description of Unknown: Firmicutes sequence
gtgagaaacaagaatattcaacaaaaggagtttgttatgaaatacgattttgcggccattgagagcaaatggcagaaaaagtgggaagaagaaaagccctacgccgccatcaccggcgacccgcggccgaagttctacggcctgattgagttcccgtatccgtcggcggccggcctgcacgtcggccatccgcgcccgttcacggcgatggacatcatctgccggaaaaagcggatgcagggttacaacgtcctcaatccgatcggctttgatgccttcggcctgccgaccgagaacttcgccatcaagaaccacattcatccggccatcgtcacgaagcagaacatcgaaaacttcacacgccagctcaaaatgctgggctacggcttcgactgggatcgcgtcgtcgatacgaccgacccgaattattaccgctggacgcagtggatcttcctccagctctacaagcacggcctggcctacaagacgacgatgccggtcaactggtgcacgagctgcaaatgcgtgctcgcgaacgaagaggtcgttgagggcgtgtgcgaacgctgcggcgcgccggtcatccgcaaggaaaagagccagtggatgctccgcatcacgaaatacgctgaccgcctgatcgacgatctggacgacgtcgattatatcgagcgcgtcaagacgcagcagcgcaactggatcggccgctcgaccggcacggaggtcacgttccagaccaacaccggcgacgctgtcacggtctacacgacccgcgtcgatacgctcttcggcgtgacctatacggtcatctcgccggagcatccgatgctgaagaagtggaagccgctgatcaaaaactggaatgaggtcgaggcctatcaggaggcggcgtcccgcaagagcgattttgagcgcggcgagctgaacaaggataagaccggtgtgcgcctcgagggcatcgaggtcacgaatccggcgaccggaaaggtcgtgccgatgttcgtttcggactatgtgctgatgggctatggcacgggcatcgtcatgggcgtgccgggccatgaccagcgtgactgggactttgcgacgaagttcggcctgccgatcgtcgaggttgtcaagggcggcgacattacgaaggaagccttcacgctcaaggacgacactgggatcatggtgaactccggtttcctgaacggcatgaccgtcaaggaggctatcccggcgatgaagcagtacgccgtcgagcagggctggggccacgaaaaggtcaactacaagctgcgcgactgggttttctcccgtcagcgctactggggcgagccgatcccgatgatctcctgcccgaagtgcggctgggtgcccatgcccgaggatcagctgccgctggtgctgccgcaggtcgaaagctacgagccgaccgacgacggcgaaagccccatttccaagatgaccgactgggtcaatacgacctgcccgtgctgcggcggcccggccaagcgcgagaccgatacgatgccgcagtgggccggttcttcgtggtacttcctgcggtatatggacccgcacgacgacaaggcacccgtctcgcatgaggcggaggaatactggggtccggtcgactggtacaacggcggcatggagcacaccacgctgcacctgctctattcccgcttctggcacaagttcctgtacgacatcggcgttgtccacacgaaggagccgtatgccaagcgcacgagccacggcatgatcctcggccagaacccgcactatgtcggcaacgtctcgacgcaggccgagaaggacgcgctcatcgcgaagtatggcaatcaggcgctgcgcccggcggtcaagatgtccaagtccctcggcaatgtcgtcaaccccgacgatgttgtcaaggcgtacggcgcggacacgatgcgcctttatatcatgttcatcggcgactttgaaaaggttgccacctggtcggacgaggccgtcaagggctgcaagcgcttcctcgaccgcgtgtggaacctcgccgatctcgtgacgaacgaggagggtgtctcccaaaagaacgcgccgatcgtccacaagacgatcaaaaaggtcacggacgacatcgacacactgaagatgaacacggccctggccgcgcagatgacgatggtcaatgagctgtattccaacggtctgtcccgcggcgactttgaggcgctgctgctgatgctgtcgccgtttgcgccgcacatggtcgaggaactgtgggaacagaagggctatgccgcgaagtacggcaagatggcgatgcagatgccgtggccggagtatgacgagagcaagaccgtggcgtcgcacgttgagatggccgtgcaggtgctcggcaagctgcgcggcacgatcaacgtcccggtcgacagcgatcaggagaccgtcgtggccgaggcgctcaagcaggagaaagtcgcgaagttcaccgagggcaagcagatcgtcaaggtcatccacgtgaagaacaagctcgtgaacctgatcgtgaaatga

SEQ ID NO: 2426 - DNA, 3621 bp, Dorea sp.
atgccagcaaataataatgaacaaacataccagcctatgacttttgatgcgatcaaaatcgggttggcatcacctgaaaaagtattagagtggtcaagaggcgaagttactaagcctgagactattaactatagaacactgaagcctgagaaagacggacttttctgcgagcgcattttcggacctagcaaggactgggaatgccactgcggaaagtacaagaaaatccgttataaaggtgtagtctgcgaccgatgcggcgttgaggttacaaagtccagtgtacgtagagagcgtatgggacacatcgctctggcggctccggtttcccatatctggtatttcaagggaatcccaagccgtatgggactgatcctggatctgtctccgagaactctggagaaggtgctgtattttgcatcttacatcgtgctggatgcaggtgatacgaacctgatgtacaaacaggtactttctgaggctgagtatcaggaagcaagagagaactggggcaatgcattccgtgtaggtatgggtgcagagtctatcaaagaacttctggaagcgattgatctggaaaaagaatacgcagagctgcaggcaggtcttgagggcgctaccggacagaagcgtgccagaatcgtaaaacgtctggaagtggtagaagcattccgtgagtcgggaaataagccggagtggatggtattgactaacatcccggttatcccgccggatcttcgtccgatggttcagctggatggtggacgtttcgccacatctgacctgaatgatctgtacagaagaattattaacagaaataaccgtctgaagagacttctggaactgggagctccggacattatcgtgagaaacgaaaagagaatgctgcaggaagcggttgacgcattaattgataatggtcgtcgtggccgtccggttacaggacctggtaaccgtgcactgaagtctctgtctgatatgctgaaaggtaagtcaggacgtttccgtcagaacctgctgggtaagcgtgttgactactcaggacgttcggttatcgtagtaggaccggagctgaagatctatcagtgtggtctgccgaaagagatggctatcgagctgttcaagcctttcgttatgaaagaactggttcagagcggagcagcccataatattaagaatgccaagaagatggtagagaagcttcagccagaggtgtgggatgtgctggaagatgttatcaaagaacatccggttatgttgaaccgtgcccctacactgcatagacttggtattcaggcgtttgagcctatccttgtagagggtaaggcgattaagcttcatccgctggtttgtacagcgtacaacgcggacttcgatggagaccagatggcggtacatcttccgctgtcagtggaagcgcaggcagagtgccgtttccttcttttgtcaccaaataacctgctgaaaccgtcggatggtggtccggtagcggtaccttcacaggatatggttcttggtatttactatctgacacaggagagaccaggagctgtcggagaaggcaagtgcttcaagagtgtaaatgaagcaattctggcttatgagaaccaggcagtgacactgcattcacgtatcaaggtgcgtgtatctaagactatgccggacggaactgttaagacaggaacggtagagtctacactgggaagatttatctttaatgagattattcctcaggatctcggatttgttgaccgtgaagttgagggcaacgagctgcttctggaagttgacttccacgtaggtaagaaacagctgaaacagattctggagaaagttattaatacacatggatcaacagctacagcagaagtactggatgcggtaaaagcaaccggatacaaatattctacaagagctgccatgaccgtagcgatcgccgatatgacggtaccgccggagaagccggaaatgatcgctcaggctcaggaaactgtagataagatcacgaagaacttcaagcgtggtctgatcacagaggaagaacgttataaggaagtcgtagagacatggaagacaaccgatgatgccctgactaaggttctgctggacggtctggatgcatacaacaacatcttcatgatggctgactcaggagcccgtggttctgataagcagatcaaacagcttgcaggtatgcgtggtttgatggctgatacaaccggacgtacgatcgagcttcctatcaagtctaacttccgtgaaggtctggacgttctggagtatttcatgtcagcgcatggagctcgaaaaggtatgtcagatacagcacttcgtactgccgactctggttacctgaccagacgaatggtagacgtttcccagcacgtgatcatccacgatgtggattgtgctcaggaaggcaagccgattccgggaatgtatgtaaaagcattcatggatggaaaagaagaaattgagagtctgcaggagcgtattacaggacgttaccttgcagaggacgtagtagataaagatggtaacccaatcgtaaaggcgaaccacatggttacaccgaaacgtgcggagaagattatgaaatacggtgttgatgaaaatggtgaatcactcaagcaggtgaagatccgtaccatcctgacatgtaaggcacacaatggtgtctgcacgaagtgttacggagccaacatggcaaccggagagccggtacaggttggtgaggctgttggaatcatcgcagcacagtctattggagagcctggtacacagctgaccatgcgtacattccatagtggtggtgtagccggagacgatatcacacagggtcttcctcgtgtcgaagagctttttgaagcaagaaagccaaagggacttgcaattatcacagagttcggcggagttgccacaatcaacgatacgaagaagaaacgtgagatcatcgttaccaatcaggaaacaggcgagtctaaggcttatctgattccttatggatcaagaattaagatcgctgatggagctgtactggaagccggtgatgagctgacagaaggtagcgttaacccacatgatatcctgaagatcaagggacttcgtgctgtacaggattacatgatccaggaggtacagagagtataccgtctgcagggtgtagaaatcaacgataagcatatcgaggtgctggttcgtcagatgctgaagaagatccgcatcgaggaagcaggagaatccggattccttccgggaacaatggttgatgtacttgagtttgaggataagaacgaagagcttgcagcagaaggacttgagcaggcaactggtgagcagatcatgcttggtattactaaggcatctcttgcaacgaactcattcctttcagcagcatcattccaggagaccacaaaggttcttaccgaagcagctattaagggtaaggtagaccatttgtgtggtatgaaggaaaatgtaattatcggtaagccaattccggctggtaccggtatgagaaagtatcgtgatgtcaaactgagtacagaactcgagatgaatgacgagatcacgttggatgacgatctggtattttcagaagaagtggatgatgtacaatag

SEQ ID NO: 2427 - DNA, 3387 bp, Dorea sp.
atggtgatcaataactggggcggtatcagtcataaagtgatggaatttcatgagtacgtgaatctgttcagcgggaaaaggggttcaggtaaatctaccgttatggatgctgtgcaggttgtattatatggaagtattgctgcgacatttttgaataaagcggcggatgacgcgaagaacagacgaagcgtgctgagctacctccggggtgcgcagaaggatggcacggcaaaccgtgagaatatggacttctgttcccagcttgtgttagagattctggatacgggaagtaatgtaacgacctgtatcggagcagcgtttgaagtaggaaagaatgataccgatgtgcgtagataccattttttcagccattccggcaagattccggaagataattacctgacagaggatggaacaccgtatacgatcggacagatcagaaagcttgtggatgagcgtaagaattcagatgataacagagggcgtggggatgtgaaccgtgtatacccatccagagaagcatatctgaatacactgtatgatgtgatctttggatatatcgatccggggcggtttatgacgatggaaaagagtgccattgcgctacggatgaccaatggtacaggtcagtttatcaaggattatatgttcccgcggagtaaggaagatacggtgtctacgatcagtgaacagctgggagcgtatcgtgagatcaaggagagggtagaagatctggagcacagaattgagatcctgtcggagattcgcgcacataatctggaacttctgcaggtgaagacagataagattcgcacggaacagattctgcgtatcttagatatcgagaactgccgcgtgcgtctggaagcgaagaagcttgatctggagggcatctgtaaacggattgaggcactggaggagaagcaggaaggactggagcagcagaaaaagattaagacggatgcactggtggaagtgcgtgcggaacttcatgcaagtgattacggtgtgaagaagaaagaactggaagatctggagacgacaatccagctgcttgcaggtaattccagacagtggcgggaaatccgtgcgggactttcccagtgggcagaagatgaagatatcagcggttatatcagcaatccaaccctgcaatgtctggaagatgtgttgggcggagaagtgacttcttctaatatggagaagttgaaaaaaggcattcaggcggcaatggaactgatcgaggaagaattggctgatctgaatgaacggatccgagagacggccaaagaactgaaagagaaacaggagatggtagaggatctaaaaaatgaccgtaagccgtatcgtaaggagttaaagagtgccagagctcagcttcagagtgaactgagcagccagtacgggcgaacgatccatgtggagatatttggcgatctttttgatattacggatgaaaaatggaagaatgctatcgaaggaagacttggaaggattaagcacagtctggtaacggagccgcagtatgcgctggatgcggcgagaatcttccgcaggatgaagcgtagggaatatgaagagattgatctgatcaatacggcagcgattaagcgcgatgagccgaaagcagaagagggaacactctatgaagcagtgcgtagcgaagaggggtatgtggatctgtgtctgcgcagatatcttggacgcatttataaatgtgagacggtagaagaactgcatcaggtgcgcgatggcgtgacaccggactgttattcttatagtaattacatattcagacatctccgggaaatggattatacccgttatgcatgtatcggtacccgagtatccaaggcgaagttaaaagagctggaagatgaagtgtttgatatgcagaaagagcagattgaagatattcagatgcgggataccctgaatcaggcacagcgatttgaacgactcagccagagtccggagcagatattaagtcttgccggggcagcagatgagctggagcgttatctggcgaaaaaggatcagcttcagcaggaattaaaagaactggaagacggaaccagaactgctgaacttaatgtcagacgggagacgctggaacgtgaagtggaagatctggaacgaaagatcaagtctgtgaatgaagaacggatcggacgtgccggagataaacggatcgctgagagtgagcagaagagttatgaagaacgtctgagtctgctgcaggaaggatttgtgccaaatcaggagcttctggcgcaggtgaaagaagttctcatgaaccgcaccgagcaggcgtaccgacgggaaaatacagaattacttgcgaagctgtctgcacaggaagaatcagccggcgaccaacggacttctgcaagaatccggtttaataatgaatatccggcgtatggatttaccagtctggagcatgacaatgatgtgtatgacaaggtgttggatcagcttcagcaggattatgagccgaagtttaaggcagaattcgagaagcagtatctgctggtatatcattccctgcgggaaaatgtgattgcgaccattcacggggagatcaaggcggcataccgtcaccggaaagagatcaaccggatgctgtcccgtatccgtttctcggacagtacgtatcagatcgatattcttccggcggataatgagaacggacagttctatgagatgctgatggcggaagaactggacagcaaggtgttagataatgacggctttgacggacagttaagttttggggaagatacattttaccagaaatacgagaagcagatcgagcgtctgacggagaaattcatgccaccgaaggatgaggatggtcagaaaagaagcctgcataagcaggagatggaaaaatatgccgattatcggaactaccttaccttcagtatgtatgagcgtgtggaagatgaacatggtaatgtgaagaagaattcggtagacgagatggcggggcgtgattccggcggtgagggacagaacccgaaatacgtcgcactgcttgcgggatttgcaatgctgtacatgcagcagagcagcagagatccaaggatccgtctggtgcttctggatgaggcattttccaagatggataaggagcgaagcgaagtgtgcctgcgctatgcgagagaactggaactgcagttaatcgtgtgcgtgccggatgaacgtctgcagtcactgatccgcaatgtggacagtgtgtatggattccgcagacataggaatcagatatccatgatgcatatcgataaagggcagtatctggaaatgatggaaggaaatgcaggcaaggaagacgtgaaagatggaagaaagcagacaggaactgatacagcagctgattaa

SEQ ID NO: 2428 - DNA, 3537 bp, Dorea sp.
atggcaagaaaaatgaagaccatggatggtaaccatgcagcggctcatgcttcctatgcatacacagacgttgcagcaatttacccaatcacaccttcatctgttatggcagaagctacagacgagtgggcaacacagggaagaaagaacatctttggacaggaagtacaggttacagagatgcagtcagaggcaggtgcagcaggtacagttcacggatctctggcagcaggagctctgacaactacttatacagcttcacagggtctgctgcttatgattccaaacctttacaaaatagctggcgagcagcttccaggtgtatttaacgtatctgctcgtgctatcgcaagccatgcattatcaatctttggagatcactcagatgtttacgcctgtcgtcagaccggatgtgctatgctctgtgagtccagtgtacaggaagtaatggacctgacaccggttgcacactgcgcagctatcaaaggacgtattccatttatcaacttcttcgatggattccgtacatcacacgagattcagaagatcgagacatgggattatgaagatctgaaagatatggtagatatggacgcagttgatgctttcagaaagcacgctctgaatccaaatcacccatgtcagagaggttcagctcagaacccggatatcttcttccaggcaagagaagcatgtaacccatattacgatgctatgccggctatcgtacaggagtacatggacaaggttaatgagaagatcggaacaaactacaaactgttcaactactatggagcagaagatgcagagcatgtaatcgttgctatgggctctgtctgtgatacaatcgacgagacagttgattacctggtggcagaaggcaagaaggttggtattgtaaaggttcgtctttacagaccattcagcgcagaagcattgatcagtgctattccggacagtgttaagacaattacagtattagacagaacaaaagagccgggagcacttggcgagccattatacctggacgttgtagcagctctgaagggatctaagttcgatgcagtaccggtacagtcaggacgttacggattaggttctaaagatacaacacctgcacagatcgttgcagtatatgagaacacaacaaaagctaaattcacaatcggtatcgtggatgatgttacaggactttcactggaagttggagcaccgctggttactacaccggaaggaacaatcaactgtaagttctggggtctgggagcagatggtactgtaggtgctaacaagaactctatcaagatcattggtgataatacagatatgtatgctcaggcatacttcgattacgactctaagaagtcaggcggtgttacaatgtctcacctgcgtttcggtaagaagccgatcaagtctacttacctgattcacaaggctaactttgtagcatgtcacaatccgtcctatgttaacaagtataacatggtacaggagctggttgatggcggtacattccttttgaactgcccatgggatatggaaggtcttgagaaacatctgccaggacaggtaaaagcattcatcgctaaccacaacatcaagctttacacaatcgacggtatcaagattggtaaagagatcggacttggcggtcgtatcaataccgtacttcagtcagcattcttcaaactggcagctatcattccggaggaagaagctatcgacctgatgaagaaagcagctaaggctacttacggaagaaaaggtgataagatcgtacagatgaactacgatgcaatcgatgctggtgctaagcaggtagttgcagtagaagtaccagagagctggaagtcatgcgaggatgaaggtctgttctcaccagaagttaagggtggaagagaagacactgttaaattcgttaagaatatccaggctaaggtaaatgctcaggaaggtaatacactgcctgtatctgcatttacagattacgtagatggttctacaccgtcaggtactgctgcatatgagaaacgtggtattgcagtagatatcccggtatggaaatcagaaaactgtatccagtgtaaccgttgtgcatatgtatgtccgcacgcagttatccgtccggtagcattgacagaagaagatatggctaaggctccggaaggactgaagacaattgatatgatcggtatgccaggtatgaagttcacaatgactgtatcagcttatgactgtacaggatgtggatcatgtgctaacgtttgcccgggcaagaagggtgagaaagcacttgttatggctaacatggaagagaatgccggagagcagacattcttcgatttcggaacagagattccggttaagccagaagttgttgctaagtttaaagagaataccgttaagggtagccagtttaaacagcctctgcttgagttctcaggtgcttgtgcaggttgtggtgagacaccttacgctaaacttataacacagttattcggtgacagaatgtacattgcgaatgcaactggatgttcatcaatctggggtaactcttcaccgtctacaccttatacagtaacaccagaaggaaaaggaccggcttggtctaactcattgttcgaagataacgctgagtttggatatggtatgctgttagctcagaaggctctgagagaaggactgaaagctaaagttgagacagtagctgcttcagaaaaagcttcagaagaagttaaggctgcttgtgctgaatggcttgacacatacggctgtggcgctactaatggaactgctacagataagcttgttgcagcattagaaggatgcgactgcgagacatgccaggatatcgttaagaataaagatttccttgctaagaaatcacagtggatcttcggtggtgacggatgggcttacgatatcggattcggtggtgttgaccatgtacttgcaagtggtaaggacatcaacgttatggtattcgatacagaggtatattctaacacaggtggacagtcttctaagtctactaagacaggtgctgttgctcagttcgcagcaggcggtaaagagactaagaagaaagaccttgctggtattgcaatgagctatggttatgtatatgttgcacagatcgctatgggtgctgacttcaatcagacagttaaggcaatcgcagaggcagaggcatatccgggaccatcactgatcatcgcatacgctccatgtatcaaccatggtattaagaagggtatgagcaaagctcagacagaggaacagcttgcagttgagtgcggatactggaataacttcagattcaacccggcagcagaaggcgctaagtttactctggacagcaaagaacctaagatggaaggatacaaagacttcctgaacggagaagttcgttacaactctcttgcaagattctatccagaaaaagcagaagttctgtttgctaagaatgaatcagaagcaaaagacagatacgaatatctgaagaagcttgttactctgtacggagcagaataa

SEQ ID NO: 2429 - DNA, 2463 bp, Dorea sp.
atgagtttaaaaattagtaagacagaatttaaaaaggatgtaatggacaactgcagaagactgttccgtaaggaacttgacgaggcaactccgcaggagcagtatcagtcagtatcttatgcagtaaaggatatgattgttgagaactggatcgcaacacagaaacagctcacaaaggatgatccaaagattgtctactatatgtccatggagttcctgatgggtcgtgcactgggtaacaacctgatcaatatgacggcttatgaggatgtgaaggaagctctggatgaactgggaatcgatctgaactttgtagaggatcaggaaccggatccggcactgggcaacggcggtctcggccgtctggctgcctgtttcctggattctctggcatctcttggatatgctgcatatggatgtggtatccgttaccgttatggtatgttcaagcagaagattgagaatggatatcaggtagagaagccggataattggctgaaatatggtaatccgtttgaacttcgcagaccggaatatgccaaagagattcgtttcggtggcaatatccgcgtagaatatgatgatgagacaggaaagactctgttcaaacaggagaattatgagtctgtactggctgttccgtatgattatccgatcgtcggatatgataataaccaggttaatacactgcgtatctgggatgcagagccgatcgtggacttccagctggattcatttgacaagggtgattaccacaaagcggtagaacagcagaaccttgctaagacgatcgtagaagtgctttatccaaatgataatcactatgcaggtaaagagcttcgtctgaaacagcagtatttctttgtatctgcaagtcttcagacagcagtagacaaatacatgagaaatcatgacgatatccgcaagctttatgagaaagcaaccttccagatgaatgatacgcatccgactgttgcagttgcagagctgatgcgtatcctgctggatgattaccagctggaatggcaggaggcatgggatgtcacaacgaaagcatgtgcatataccaaccatacaattatggcagaagcactggagaaatggccgatcgacctgttctcaagactgcttccgagagtatatcagatcattcaggaaattgatcgtcgcttcatcatccaggtagaagagatgtatcctggcaatgaagataagaagagaacaatgggtatcttgagagatggtcaggtgagaatggcaaatcttgcaatcgtagctggttactctgtcaacggtgtagcaagactgcacacagagattctgaagaaacgtgaactgaaggatttctatgagatgatgcctgagaaattcaataacaagaccaatggtatcactcagagacgtttcctgatgcacggtaatccgctgcttgcttcctgggtaactgaaaagctcggtacaaaagcatgggctacagacttgtcactgatgtccggtctgaagaaatatgtagatgacccgaaagcacagcaggagttcatggatattaaatacaagaacaaagagcgtctggcaaaatacatccttgagcataatggaatcgaagtggatccgagatccattttcgatgtacaggtaaaacgtttgcacgagtacaaacgtcagcttctgaacattatgcatgtaatgtacctgtataataagattaaagagcatccggaactgagtttctatcctcgtacatttatctttggagcaaaagcttctgcaggatatattcgtgcgaaagagattatcaagctgatcaactctgtagcagatgtgatcaataatgaccgcagtatcaacggtaagatcaaggtagtatttatcgaagattaccgcgtatcaaatgcagaatggatcttcgcagcagcagatgtcagcgagcagatttcaactgcatcaaaggaagcatccggaacaggtaatatgaaattcatgctgaacggtgctccgacactgggaaccatggatggagccaatgttgagatcgtagaagaagtaggttctgagaatgcatttatcttcggaatgagctctgatgaagttatgaattacgagaagaatggaggatacaatccttacgagatctacaataatgatgcagatatccgcagagttgtagaccagctggtagatggcacatatgcagatggagatacagagcgttaccgcgatctgtacaacagtctgttgaatacaaattgcagcgaccgcgcagatatgtatttcattctgaaagatttccgttcttacgcagaagcacaggagcgtgtagaagcagcatacaaagacagagaaggatgggctagaatggcacttctgaatactgcatgctgtggtaagttctcttccgacagaacaattgaagagtacgcaaaagagatctggcatctgcataagattaaggttgaagcataa

SEQ ID NO: 2430 - DNA, 3150 bp, Dorea sp.
atgtacaagaaagtgtctaccgatctcaagtttgtagatcgtgaaaaagagactgagaagttctgggaagaaaatcatatttttgaaaagagtatggaaaatcgtaaagagggagagacctatacattctatgatggaccaccgacagccaatggtaagccacatatcggtcatgtactgactcgtgttatcaaagatatgattccgagatatcgtactatgaaaggatatatggtacctcgtaaggcaggatgggatacgcacggactgccggttgaactggaagttgaaaagctcttgggcttggatggaaaggatcagatcgaagagtatggtctggagccgttcattaacaaatgtaaagagagtgtctggaaatataaagaaatgtgggaagatttctcaagcaccgtaggtttctgggcagatatggataatccatatgttacttatgataataactttatcgagtctgagtggtgggctttgaagaagatctgggataaaggacttctttataagggattcaagattgtaccttactgtcctcgctgcggaactccgctgtcagctcaggaagtagcgcagggatacaaagatgtaaaagagcgttcagcaattgttcgctttaaggtaaaaggtgaggatacttatttcctggcatggacaactacaccttggacattaccgtctaatatcggtctttgtgtgaatccggaagaagaatatgctaaagtaaaatgtgtagacggatatacctattatatggcatctgcacttctggatactgtacttggcaagctcgctgaagatggcaagccggcatacgaggtactggagacttacaaaggaaaagatctggaatacaaagaatatgagccgttatatcagtgtgcagcagactgcgcagcaaaacagaacaagaaatgtttcttcgttacatgtgatgattatgtaacactgacagatggtaccggtgttgtacacattgcacctgcatttggtgaagatgatgctaaggttggacgtaaatataacttcccatttgtacagttagtagatgaaaaaggtaacatgggagagacaactccatttgccggattatttgttaagaaagctgacccggaagtcctgaaagatctggatggaagaggacttctctttgacgcaccgaagttcgagcatagctacccgcactgctggagatgtgatactccgctgatctactacgcaagagagtcatggttcatcaagatgacagatgtgaaggatgaactgatcgctaataataacacaatcaactggattccggaaagtatcggtaagggacgtttcggagactggcttgaaaatgtacaggactggggtatcagccgtaaccgttactggggtactccgctgaatatctgggaatgtgaatgcggacatcagcattcaatcggaagtatcgaagagctgaagagcatgtctgataactgtccggataatatcgaacttcaccgtccatacatcgatgaagtgaccattaagtgtccgaagtgcggtaagccaatgcaccgtgtaccggaagtaattgattgctggtttgacagtggttctatgccatttgcacagcatcattatccatttgagaataaagaactgtttgaacagcagttcccggcacagtttatttcagaagccgttgaccagactcgtggatggttctactcactgcttgcaatttcaacactgatcttcaacaaagcaccatatgagaacgttatcgttcttggacatgtgcaggatgaaaatggtcagaagatgagtaagtctaagggtaatgcggtagatccgtttgatgcactggagaagtacggcgcagatgcgatccgttggtatttctatgttaatagtgcaccatggctgccgaaccgtttccatggcaaggctgtagtagaaggacagagaaaattcatgggtactttgtggaatacttatgcattctttgtactgtatgcgaacatcgatgaatttgatgctaccaaatatacactggattatgagaaattatccgttatggataaatggctgctgtccaagttgaatagtatgattaaagaggtagattatgacctcggcaattaccgcatcccggaagctgcgagagcattgcaggatttcgtggatgatatgagtaactggtatgtaagaagaagccgtgagcgtttctgggcaaaaggaatggagcaggataagatcaatgcttatatgactctgtataccgcactggtagaatgcagcaaagcagcagctccaatgattccatttatgacagaagagatttaccagaacctggttagaagcattgacgcttcagctccggaaagtattcacctgtgtgacttcccggctgtacacgagaatcatatcgatacagaactggaaaataatatggacgaagtcctgaagctggtagtaatgggtcgtgcatgccgtaacacagctaatatcaagaaccgtcagccaatcggtcagatgtttgtaaaggcagataaggtattgccggaattctatcaggatattgtaaaagacgagctgaatgtaaaagttgtaacatttacacaggatgtaagaagctttacttcttattcattcaaaccacagcttaagacagtcggaccgaaatacggtaagatgcttggcggtattaaagcggtgctttcttctctggatggcaacgcagcaatggatgagctgaatgcgacagaggctctgaaactggatgtaaatggacaggagattactctcttccgtgaagacctgctgattgagactgctcagatggaaggatatgtatctgaaaatgataatggaattaccgtagtactggatacgaatctgacaccggaacttctggaagaaggattcgtaagagaaatcatcagtaagattcagaccatgcgtaaagaagcagatttcgaggtaatggataagatcacagtaacttatacaggtacagagaaggctgagaagatatttgcagacaatgcagatatgatcggaactgagacactggcagtcagcgtacagaaagctgaacctgcaggatatgtcaaagagtggaagatcaacggagaaaatgtaacgcttggcgtagcaaaaatgtaa

SEQ ID NO: 2431 - DNA, 2658 bp, Dorea sp.
atgagtcagaatcttgaaacaacttacaatccgaaagcgattgaagacaagctgtacagcaagtggtgtgaaaagaagtattttcacgcagaagtagacagaagcaagaagccatttaccattgttatgccgccgccgaatatcacaggtaagttgcatatgggacatgcgctggataacacgatgcaggatatcctgattcgttataagagaatgcagggatataatgctttgtgggtaccgggtacagaccacgctgcaatctcaactgaggttaaggttaccaatcagctgaaagaagaaggtatcgataagaaggaaatgggacgtgagaagttcctggagagaacctggcagtggaaagaagagtacggcggaacgatcaaggagcagcttaagaaacttggcgtatcctgtgactgggaccgcgagcgttttaccatggacgaaggatgctcaaaggctgttgaagaagtatttatcaatctttataagaagggatacatttataagggatccagaatcatcaactggtgtccggtatgtaagacttctctgtcagacgcagaggttgagcatgaggagcaggatggacatttttggcatatcaagtatccgatcgtaggaagtgatgattatcttgagatcgctactacccgtccggagactatgcttggtgatactgcgatcgcagtacatccggatgatgagcgctataaagagctggtaggaaagaatgtaattctgccgctggttaacaaagagattccgattgtagcagattactatgtagataaagaatttggaacaggtgcggttaagattacaccggcacacgaccctaacgattttgaggtcggtaagcgtcacaatctgccagagatcaacatcatgaatgatgatggtacgatcaatgaaaacggcggtaaatacgcaggtatggaccgttacgaagcgcgtaaggttatggtaaaagaactggaggagcagggacttctggttaaagtggttccacattctcataatgtaggtacacatgaccgctgccatacaacggttgagccactgatcaaacagcagtggttcgttaagatggatgagcttgccaagccggcgatcgaagcgatcaagaacggcgacctgaagttcgtaccagagcgttttgacaagatttatctgcattggctggagaacatccgtgactggtgtatttcaagacagatctggtggggacaccgtattccggcatattactgtgacgaatgtggcgagatggtagttgctaaagagaaaccatctgtatgcccgaaatgcggatgtacacacatgacacaggatgaggatacactggatacctggttctcatcagcactgtggccgttctctacgctgggatggccggaacagacagaagatctggattatttctatccgacggatgtactggtaaccggatatgacatcatcttcttctgggtaatccgtatggtattctccggatatgcacacaccggcaagtcaccattccacacggtactgatccatggactggtacgtgactcacagggacgtaagatgagtaaatctctgggcaatggtatcgatccgctggatattatcgatcagtatggtacagatgcacttcgtatgacattgatcacaggtaatgcgcctggtaatgacatgcgtttctataatgaaagagtagaggcaagccgtaattttgccaataaggtatggaatgcgtctcgtttcatccttatgaatatggatggaaagaatgtaacgaagccggaagcctctgaactgatgccggcagatcagtggattctgtctgcatgcaatacactggtgaaggacgttacagagaacctggataaattcgaactgggtattgccctttctaaggtatacgatttcgtatgggatgagttctgtgactggtacattgagatcgccaagtatcgtatgtatcatgcagaggaagatccaaagggagcaaatgctgcattgtggacattgcgtgaagtactgaagacctccctgaagctgttgcatccatacattccatttgtaacagaagagatttacagcaagctggttccggaagaggaatcactgatgatgtctgcatggccggtatacgatgaagcagcaagcttcccggaggctgaagacgtactgaaccattacaaagagattgtaagaggcgtacgtaatgtacgtgcagaaatgaatgtaccgaattcacgcaaggctacgatttatgtagtatgcgaaaatgcaaagctgagccagggacttatgagtctgaaagattcagtgaaactgatggcagcagccaatgactttgtgatccagacagacaagaccggcattgcagatgatgccgtatctatcgtagttccggatgcaaccgtatatcttccgatggaagaactgattgactttgcacaggagatcgaacgtcttgctaaagaagagacaagacttcagaaagagatcgcacgtgcaaatggcatgctgaacaatgagaagtttgtcagcaaggcaccggaagcaaaggtacaggaagagcgtgagaaactggaaaaatatcagcagatgcttgctcaggtacaggagcgtcttgccggactgaaagaaaaatgtaaataa

SEQ ID NO: 2432 - DNA, 3342 bp, Dorea sp.
atgcaggcgctgatagggccgttgcaggaactggctgaatttgaagcaattcagaaagaaaaacagaaagaagccggagtactgcagatatccggctgtgtaaattctcagaaaacgcatatgatgtacgcactgggcgatggctgtaaatacagagtcatcgcttgttccagtgagtcaaaagcaagacaggtatatgaggaatatcatatgctggatccggagacttatttttatccggcaaaggatttccttttttatcaggcagatatccgcagcaaggaacttcaggaatcccgcatgacagtagtacaggcaattctggaggaaaaaccgttgactgtagtggtgtcttttgatgcatttatggatgcacttccagtgaaaggtgctatgaaagaccgggtgatccggattgaaaacggacagacactggactttgatgagatccggaaagcgttgacggagaatggctatgacagggaagaacaggtcgacggaccgggacagtttgcgatccgcggtggtatcctggatatttatccgttgaccggggagcttcctgtgcgtattgagctgtggggagatgaagtggattctattcgaagcttcgatacagacagtcagcgttccgtgcagaatctggatgaggcagtgatctatccggcagatgagcttccgggaaggccgggaaaacgagtgtcatttctggaatattttccgccggaagatacgttggtatttttggatgaaccgactaggctggtagaaaagggcgaggcagtagaacaggaatttgtagaagcgcaggcaaaacgcgtggaaagtggttatgaagtatcggatgatgagatggagctgtatgagacggcagagatcgtaaagcggatgaatacctattactgcattggattgtctgcgcttgaaactcatggcaatggttttagattccggaataaattcagcattaatacgaagagtgtgaatccgtataataacagttttgagatgctgacgagagacctgaagcgtctgaaacggaatgattacagagtgatattgttgtcaggttccagaaccagggcgaagcgtctggcggaggatctgcgagattataatctgagcagttattacagtgaagagcaggacagagaagtgcagcctggtgagattatgacagcttatggtcatgtggcagagggctatgagtatccgatgctgaagtttacggtgatctcggaaacagacattttcggtaaagtgcgtaagaaacgcaagcgtaaaaaatacgaaggccgcaagatccgtgactttacggaactgaaggtgggcgactatgtggtacatgagaatcacggtgtcggcatttaccaggggattgagaagattgaatcggataagattgccaaggattatatgaagatttcatatgcagcaggcggtaatctgtacattccggcaacgcagctggatctgatccagaaatacgccagcgccgatgccaggaagccaaagctgaatcgtcttggcacgcaggactggaccagaacgagaaaacgcgtcaaaagtgcggtacaattaatcgcaaaagatctggtgaagttgtatgcggcaagacaggagcaggaaggttttgtatatggcgaggataccgtatggcagcgggaatttgaagagatgtttccgtttgaggagacagaagatcagatgcttgccattgatgcggtaaaacaggatatggagagcactaagatcatggatcgtctgatctgtggggatgtgggctatggcaagacggaagttgcaatccgtgcggcatttaaggcagtgcaggagaataagcaggtcgtatatctggtgccgacgacgattcttgcccagcagcattacaatacctttgcccagcgtatgaaggaatttccggtgcgggtggatctgatgtgcagattccggacggcagcccagcagaagaagaccatcgaggatacgaaaaaaggtctggtagatattattatcggtacccaccgggtgctcagtgatgatctggaattcaaggatttggggcttttgatcattgacgaggaacagcgttttggtgtccagcataaggagaagatcaagaagctgaaggaaaatgtagatgtgctggcgcttacggcaacaccaatcccgcgtacccttcatatgagcctgatcggaatccgtgatatgagtgtgctggaagaggcaccggaagagcgtatgccgattcagacgtatgtgatggaatataatgacgagatggtgcgggaagctatccagagggagtgcgcccgccagggacaggtttattatgtctataatcgggtggataatattgcggaagtcagtgcgcatattcagaagctggtgccggaagcggtggtagcctatgcccatggacagatgcgggaacatcagcttgagaagatcatgctggactttatcaatggcgagattgacgtgctggtatcgaccacgatcattgaaacaggactggatatttccaatgccaatactatgatcatccacgatgcagaccggctgggactgtcgcagttgtatcagctccgtggacgtgtgggacgatccaaccgtatggcatatgcgttcttaatgtatcagagaaataaattactgcgggaagaagcagagaagcgtctggcagcaatccgtgaatttacggatcttgggtctggatttaagatcgccatgagggatctggagatccggggcgcaggtaacctgctgggagcagagcagcatggacatatggaagcggttggatatgatatgtactgcaaaatgttgaacgaggcagtgcgtacgttgaaaggtgaagcggaggatgagggctttacgactacaatggatctgaatgtagatgcatttattccggattcatatattccgaatgagtatcagaagttggatatctacaaacggatcgcagtgattgagaatgaagaagagatggaagatatgacggaagagctgatcgaccgttatggtgatattcctcgaaaggttatgaagcttctggaagtggcaacgctgaaggcattggcgcatagtgtttatgtgacagcagtggagcagaaaggtgagcagtatatatttaccatgtacgagaaagcgaaggtgcgtccggagaagataccggagctgatacagcagtacaaaggggatctgacctttaaaccagaggagccgccggtgtttatttatgaagaaaagaagaagaaccggaaggcgaaggctgtggatgctctggtagttgtgaaaaatgtcttaaatgccatgaaagcattgcttgatacttaa

SEQ ID NO: 2433 - DNA, 3495 bp, Dorea sp.
atggaaaaatatttgcagattcatagcctggaagaattggttgacagatttcaagacagatgccgggaggaatatatggcattacaatttgtatttgggggttccggttccggaaagtcccactatttatatcagagaattatacaggaggcaggggaacaccctgcccttaattacatggtcctggtgccggagcagtttacgatgcagacgcagaaggaccttgttttgatgaacgagaaaaagggcattatgaatatcgatgtgttgagtttcggacgactggcatatcggatttttgaagagacagggaaaggaaatacgcctgtgctggacgatgagggcaagaacctgatcttgcgcaagattgccggagatatcgaaccggagctgcttgtgctgaaaggcaacatgaagcgtctcggctatatcagtgaggtgaagtcggttctgtcggagttcgaccagtatgatatcggggaagaagaactggactgcgtgatgaagcgggcaggagaagaatcttatctgtattataagttaaaggatatgagccttatatataagaagtttcgggaatatctccaggacagatatattaccaaagaggaaattctggatgtgctgtgcagaacagtgccagaatcggaactgctgaagcggagtgtggtcgtgctggatggatttaccggatttactccggtgcagaacagactgcttgcggagcttatgaagcttgccagagatgtgatcgtgacagtaaccatcgatgacagagaagatccttaccgttatacggatgcctgccagatgtttgggatgagtaagcatacggtgacaacactgacgaggattgccagagagtgcggtgtggagcagagggaaccggtatggctcaaaaagagaccgttttaccgttttcggaaaagcgaggcacttgcctttttggaggagcatcttttccgttattcgggcagatattatatcgggaagccggacacgatcgcgattcatgagaccagaacaccaaaggaagaagcctatgcggcagctgcgcagatccgcaggcttgtgcgggaagagggcatgcgttaccgggagattggtgtagtggcaacggatcttaatggctatggcgattatctggaagaagcatttgccaaatacaggattccggtatttatggattataagcggagtattctgctgaattcttttgtggagtatgtgcgaagcattttgaatatggcggagcagagctttacttatgagagcgtgtttcgcttcttaagagcaggttatggaccgtttacagatgacgaggtggatgagctggagaattactgtctggcacttggtatccgtgggtataaaaactggcagcagcgatgggtgcgcaaaggtgcagatgtgacagaggacgaactggagcatctgaatcaccttcgggtgaaactggtggagctggtggacggtctgctttttgtactgcggcagcggaagaaaacggtgcgtgatattaccgaggcactttaccgttttctggaagagcaggaactgcagcaggaattaaaacggcaggaggatgcattcacggaagagggagaacttgcgcttgccagagaatatgcacaggtatatagtgctttgattggtctcttcgacaaatttgtagagcttttgggagacgaaccggtaacattaaaggaatacgtggagcttctggatgccggactgaatgagattaagattggtgtaattccgccgggattggatcaggtgatcgccggggatgtacagcgaaccagattaaaagatatccgtgtactgctgatgcttggagtcaatgattcgctgcttccgggcaatctgatgcggacaggactgttaagtgaacaggacagagcgcagtttgagcaggaaaatctctcactcacaccgggtggaagagaacaggcatatattcagaaattttatctgtatctgaatctgaccaaaccggaagaggaactgcatttgttttacagcagatcgggagcagatggcaaagcaaagcgtccggcgtatctgatcggtgagatccgcagattattcccggatgcgccggtgatcgatgaggcgtcaaggccgttaactgagcaggagctgacgccggagatcggactgcaggaactgatccggggactccgcatgcagagtgatgcaggcggcagcagctggatggagctttataactggtataagaagcattccgaatgggcagagaagatcggagatcttctggatgcgtcattttattcttatcatccgaaacagatcagtgaggaagcagcaaagctcctttatggtacgcatttccagaacagcatttcccgaatggagaaattctctgcctgtgcatttgcacatttcctggcgtacggattgcgtttgaaggaacggaaagaatacgagttccagccactggatctgggaaatgtctttcacagtgcgatggagcgctattccggcaaagcggaaaaagaaggcggatggacgaagatagaagaagagaagcgacagcagctggtgcgggagagtctggatgaatccattgcggattacggtaattctgtactgtacagttctgccagaaatgaatacatgatcacaagacttgaccgtctgctgaaccgcacggtctgggcacttaccgaacagttagccaggggtgattttgagccgtcggcatatgagctgtcctttggcagtggcaagatcgaccggattgatgtgtgcgagacacgggatgaagtctatgtgaaggttatcgattataagaccggacagaagggattcgatgtgtcagcactttattatggattgcagttacagctgatggtatatatgaatgcggcaaccgaccgtatgaagaaacgatatccgggtaaacaggtgatcccggcgggcgtattttattaccggatgaaggatccgctgttggagaaaaatggtaaagcagatcttgaaaaaaggcttctgaaggaattgcgcccggacggcgtggtgaatctggagcagaacagtctggaacatctggaaagggattgtacaggagattcattggctgtgccggtgaagtttaataatgacggaagtctttctaaagtatccagagcggtcagccaggaagaattccacaccatgatggagtatgcagatcagaaagcggcagagatcagacagcagattgtccggggtgaggtggcagtgcagccatatcgccagggtcaaaatcatgagtgcgagcattgtatttatcagcagatttgtggatttgatccgcagcttgacggctatgaatatttggacagaaagaagctgacgcgcgaggaagcggttgcaaagatgcagagtgcagtatcaggagaaacaggaaaggtagctgatacttttaatagaaaggaggatacgccatgggagtccagtggaccgaagaacagtggcaggtcatag

SEQ ID NO: 2434 - DNA, 3813 bp, Dorea sp.
atgagtaatgtaaaacgggtgtttgttgagaaaaagggagaatacgcagttcaggcaaagggtctgttacatgagattaagggctatcttggaattaaggatgtagaaagtgtaagagtcctgatccgctatgatgtagagaacctgtctgatgagacgtttgagaaggcatgcagaggtatttttgctgagatgccggtagatattttatggaaagagagcgttccggtcatgcagggagacagtgtgttttctgtagagttccttccgggacagtttgaccagagagctgactcggcagagcagtgtgtgcagtttattaaggaggatgagaagccggttatccgtacagctacgacttatattattcatggaaaaggcgataactgtatttcaacagaagagttagaggcaatcaagaatcactgcattaatccggtagattccagagaagcagaagaagagaagccggagacgttgatcacaaagtttgatgagccggaggatgtaaaggtatttgatggattccagacgatggatgaagaacatctgaaagcattatatgattcgctgggacttgcaatgacattccgtgacttctgccatattcagaattattttgcaggagaagaacacagagatccgactatgacagagatccgggtactggatacatactggtcagatcactgtcgtcatacaacattctctacagaattgaaggatgtaacttttggtgatggtgattacagagagccgattgaaggcgcatataagcagtatcttgctgatcacagcgagatctttaagggaagagaagataagtttgtctgcctgatggatcttgcactgatggcgatgagaaagttgaaaaaagaaggtaagttacaggatcaggaagagtctgacgagatcaatgcctgcagcattgtagtacctgtaactgttgatggtgtagaagaagagtggctggtgaatttcaagaatgagacgcacaaccatccgacagagatcgagccatttggtggtgctgctacctgtctgggaggtgcaatccgtgatccgttgtcaggacgtacctatgtatatcaggctatgcgtgtgactggtgcagcagatccgacagtatctgtaaaagagacgattaagggtaagcttccgcagaagaaactggtacgtgaagcggctcatggatacagctcatacggtaaccagatcggactggcaaccggagcagtaaaagagatttatcatccgaattatgtggctaagcgtatggaaatcggggcggtcatgggagcagcaccgagacgtgcggttatccgtgagacttcagatccgggagatattatcattcttcttggtggacgtaccgggcgtgacggctgtggtggagctaccggttcttctaaggtacacacagaagagtctatcgagacctgcggtgctgaggtacagaaaggtaatgcacctacagagcgtaagattcagagactgttccgcagagaagaggtcagcagtctgattaaaaaatgtaatgactttggagcaggcggtgtgtctgtagcaatcggtgaacttgcagacggtctgcagattgatctggacaaggtgcctaagaaatacgcaggacttgatggtactgagattgcaatttccgaatctcaggagcgtatggcagttgtcgtagatccaaaagatgtagatgaatttatgggatatgccagcgaagagaatctggaagctactaaggtggcggttgtaacagaagatccaagactggtgcttaattggagaggcaaggatatcgtgaatctgtcccgtgcatttctggataccaacggagcacatcaggagactacggtagcagtagatattccgaaccgtgcagatacgattctcacagatgaagtggaagtgacagatgtaaaggagaaatggctggagacattaaaagacctgaacgtatgctcacagaagggtctggtagagatgttcgacggttccattggttctggttctgtattcatgcctcatggcggcaaatatcagctgacagagacacaggcaatggtcgcgaagcttccagtactgaagggcgactgtgatactgtaacgatgatgagctatggatttgatccatatctgtcaagctggagcccattccatggtgcaatctatgcagtgacagagtctgtagctaagatcgtggcagcaggtggagattataagaagattcgttttactttccaggagtacttccgtcgtatgacagaagacccgcatagatggagtcagccgtttgcagcactgcttggcgcatatgatgcacagcttggatttggacttccgtctatcggtggtaaggacagtatgtcagggacatttgaagatattgatgtaccgccgacactggtatcatttgcagtagatgtggcaaaagaaaaagatattatcactccggaacttaagaaagcaggaagcaagctgatctggatcaagactccaaaggcagagtatgatcttccggattatgagaagctgatggcggtttatgagaagttctcagaggcagtgcatacaggtaaggtattatctgcatatgtattggatcgtcacggtgtagttccggcagttagcaagatggcatttggtaatagcatgggcgtgaagctgtctgacgagattccggcaggtcagttatttgcaccggcatttacagatatcgtggctgaggtggaagctgataagattgatgaacttggatttgaatatgttgagatcggtgaagtgactgcagagccgaactttgtatatggtaataccgtaatcacaattaaagaagcagtagacgcatggaaagagactctggaaagagtatttaagaccgtatccggagaagagacaggaagtgcagttccggaagtgggagaagagaagtcttctgatggcaaacttggagaagatgggctgttccgtgcatctaaggtatatgtatgcgagcataagatcgcacagccgacagtattcatcccggtattccctggaaccaactgcgaatatgacagtgccaaggcatttgagcgtgccggagcaaaggtgatcaccaaggtattccgcaatatggatgcgtcagatatccgtgattcggtagaagtatttgaaaaagcaatcagtcagtcgcagatcatcatgttcccgggcggattcagtgcaggtgatgagccagatggatcagccaaattctttgcaactgcattccagaacgcaaagctgaaagaggcagtgcagaagcttttgaatgagagagatggtctggcacttggtatctgtaatggattccaggcactgatcaagcttggtcttgtgccaaacggagatatcgtaggacaggatgagaatgcaccgacactgacatacaatacgattggacgccatatttccaagatgatatataccaaagtggttacaaataaatctccatggcttcagaaagcagagcttggcggagtatataccaatcctgcatctcatggagagggacgttttgtcgctaacaaggaatggcttgcaaaactctttgcaaatggacaggtagcaacccagtattgtgacccggagggcaatattaccatggatgaagagtggaatgtcaatggatcttactgcgcgatcgagggaattacaagcccggacggaagagtgcttggtaagatggcacattccgagagacggggacgttctgtagcaattaatatctatggtgagcaagatatgaaagtatttgaatcaggtgtagagtattttaaataa

SEQ ID NO: 2435 - DNA, 3270 bp, Dorea sp.
gtggttggtattgcctttaaacatgaaacaatgctatacttcattatagtatgtttaaagaaaaaagcaatgcaagaagaggtggatggcttgaaaaataaaattaaaaagttttcaaaaggagattttcaactggcgcagccgcaggttgtctttccggatacaagcctgattctcaccattggtgaaggggaagtttataagggatatttcatgatcaagaatcgaggggaaggctctatcagagggctggtatactcgtcttcttttcgtatgcgttgtctggaacagggatttgaagggaatccggtaagagtagaatttgaatatgatggcagaggactgctgccgggacatgtggagcagggaacatttaccgttgtgtgtaccggaggagaatatacgattccgtttacagcattgatagagaaaccttatgtaatgacgaattacggtaaggtgcagaatacggatgatttccgaagactggcggttaaggattatacagaagcattgaagttattccgttcccgtgaattttatgaagtgttaaaatacgaggataagcgtatcttttatttatatgataatatgcgcaaatggtctctggatgaagctgctatggaagagtttctggtaggtattaaacagaaagaatgcattttcctgacacttccgggggaaggtatgctgtttcaggacgtgaaggagattaccaagcagacgctgacagtgatcaagaatacctggggatatatgccggttcagatccagacagagggcgaattcttaagcgtcagccgcaaccgttttacgacagacgattttgtgggcaatgtataccaggtagattttcttgtgaagccggacggcctgcatgcaggacgtaactttggtaagatccatctgatcactccgtatgagattctgagttatgatgtggaggttatgcagaatggctcctatgatgagaatcatcgagagatcgaatttttgatggcacaagtagtaaaggaacatgtttcctgtgtggcaggccgcatgacgttggataaatggacagagagtgctgtggataaggtgaagaagatgcgtcagatcgatccgctggatgagtatcttcagttatttcaggcacatgtatatattcatggcaatcagatcgaagatgccaagtggattctggagaattataattataaccggtttgcgatcggtaagaatccgaaggtgaatgcttactatctgtatctgacggcattggtgcgtggacatggaagtcatatggatcgtgtgatagatgaggttggtaagatttatctcagacagcaggattcgaccatgcttctgttgatgcttctggatattgacccacagtatcgggacaagggcagacgtctggcggcactggaacagcattatcagaattatcggaccaatggagtcttatttctgttagaagcatttcagtgttatgaagagaagagcctgcttttgaagaagcttggacagttcgagatgatggtattgaattttgcatcaaaatatcgcctgatttccagagaaatggccatgtatgtggctaatcttgccagccagcagaaaaattacagtgaatttctgtttcatattctggaacggttatataagctttatgcagaaccgatgatcctgaatgcaatctgtacgctgctcatcaagggcaataagctggataaccgttattttgtatggtatcagagagcggttaatgaaggatttaagattgcacagctttatgagtattatatgtctacgattgaagaagatgatgtgagagaagcattgccgaagtctatctttctgtattttatgcatggtaacacactgaattataaaaaagcagcactgctttatgcgaatctgatcacttatgaagagaatgccagtgatctgtatatcagctaccgggagcagatggtggcgtttgcatgggaacagcttatgaagcgtcatattacggaatcgctgaaggtgatttataagaagttctgtacagaggaagagatgaccggagaacgtctggaagctatgcgtgatatctgccatgcatatctggtgaagactaaggtgcataatttgaaatgtgccctggtcattgaaaaggatggtacagtaaagcagagaattccgtacagaccggatggtatgatcgtttatctgtacgataaggaagcaaggattatctggcagaccatggatggaggatatcatacggattccattgcatttgagacgaagcgtctgttctatgaaccacgttatctggaaatgtgcaagaaatacatgtccagaatttccaactggggtgcagagaataataaactggaagtgaattttgaaaatatccggaagaatggtatcagggcttttgatgaaaaagaggtatttcgtctgtgtagtaagacgatccgtgaagaggattatgatgaagacgaatttatgctgtatttgagctatgagctttttaagagacagcagtatgataaaatgacactgacctatcttgctgattattactgtggttctacacggaatatgaaagtgttgtggaaagtggcgaaagattacggaattgctgtgaccaagcttggtgagcgtattattacgcagatgctgttctcggaagatatgtttgcagaagaagatatatttattgattattatctgaatggcaatccgtatttccgtctaaaacaggcatatcttgcttatgtgagcagggaatatgtagtgtatggaagaagcgtaggtgcctccatctttgatatcattatgaatgaagagaaaaatgacgaggatctggcagatatctgtaaagtggctctgctgaaacgttttgccggaaaagagtacggagaggaagagggagagatcctgcatcgtttcctgcgggaaatgtgtgagcgtcagctggtatttccgttctatatggaatacgaggagtcgtggctcagagaggcacagatttacgataaaactatggtgagtttccaggcatcccatggaggaaaagtgcgtattacgtataagatgcgccgcggtgatgtggaagatcttggctatcagacagagagtctgatgccggtatatgagaatatctacgtgaaaagcttcgtgttattccaggatgaacaggttcgctattcattctgtgagacaagtggcaagaagtcctatacggatccggaagaggtgctgaaacaggaacggaaggtgccagagattggt

SEQ ID NO: 2436 - DNA, 3561 bp, Dorea sp.
atgtatttaaaaagcattgaagtacagggcttcaaatcgtttgcaaataaaatcgtatttgattttcataacggtattacaggcatcgtaggtccgaatggaagtggtaagagtaatgttgccgatgccgtgcgatgggttcttggcgaacagagagttaagcagcttcgaggcggtagcatgcaggacgttatcttttccggaacagagaaccgcaagccgttaagttacgcttatgtggcaattacgttggataattctgatcatcagctcgcggtcgattacgaggaagtgactgtagcgagaaagttgtatcgttccggtgagagcgaatatctgatcaatggtcattcctgccgtttgaaggatgtgaatgagcttttttatgataccggtatcggtaaagagggatattcgatcatcggccagggacagatcgaccgtatcttaagcggtaagccggaagaacgaagagaactctttgatgaagcagcgggtattgtgaagttcaaacgccgtaagaatatgtcattgaagaagctggaagatgagaggcagaatctggtccgggtcaatgatattctgagtgagcttgagaagcagtgggaacctctgaaaaaacagtcagagacagcgagagaatatctgaaaaagaaggagtctttgaagacctttgatatcaatatgttccttctggaaagcgaacgcctgaaagagcagattcgtgatatggagaataagattcagactgctaagggtgaacttgagaaggatactgcggactatgacaatatgaagaccgaatacgaggctgttgaggaagagatggaacagattgatgagtccattgaaagttataagtccaagaagaatgagacaagccttttgaaacagaatctggagaatcagatcgctttgttaaaggagcagatcaacagtgcacagatgagcgatgaacatttcgctcagcgttctaatgcaatccgcgaggagatagagagcagacaggctcagaaacaggatctgcaggaagaggaaagaggactgcaggaacagttatctgagcagcagaaaaaggaaacggaatcgaaagtaaagcttgccgcattacagagccagattggtaagcttggtgatgatattgaaacctggaaaaatgatatgatcgagctgctcaacaaccgtgcttctacacaggcgaaggggcagcgctatgatacgatgctggagcagattcaggtgcgtaaggcagagatccagagcagactgctgacttctcagagcgaggcaggctctgtacaggagaatctgcagtcttatgagcaggagctgaaagagatttcggataagatcattgaactgacagaatccaatcaggcgaatgaagatgagatcgcagagatccagaaggaaatgcagggcaaatccgaagaactgcgtaatagacagacttcatatcacagggacagatccagactggaatctctgcgcaatatcacagaacgctatgacggatatggtaatagtatccgtaaggttatggagtgccgcaacagagaaccgggtcttcttggtgtcgtagcggatatcgtaaaggtagaaaaggcttacgaagcggcgatcgagacagcccttggcggtagtatccagaatattgttacagataatgaagacaccgctaaacgaatgatcggatttctgaaaaagaataaatatggacgtgcgacatttctgccattgaccagcgtgtcagcaagaagcggtctgaaccgtccggaggtattaaaagaaactggtgtcatcggacttgcagatacgttggtaaaggtagatccaaagtaccgggagcttgcagcaagccttcttggaagaacagtggttgtagacaatattgaccgtgggattgcgattgcaagaaagtataagcagtccctgcgtctggtcacactggaaggagatctgttgaatccgggcggatctatgactggtggagcatttcgtaattccagtaacctgctaagccgcaggcgtgagattgaagatcttgagaaacgtgtagcacactggaaagaaagcatggagctgctggaactggagacggaagcactccgcgccagaagaactgcctgttatacggctatggatgaagtacagaaagaattgcaggaagcttatgttgttcagaatacagctaagatgaatgtggatcaggcatccaaacggatctcggcggcattgcaggcagccaagcaggcaaaggatgagacggcggaactgaatcagcagattgcagatatcggagataatcagggagctattgcacaggagttaaaagattctgaacagatggagcaggagattaaccgcaaggcttctgaggggcagaaagcactggaagaacttcgcaaacaggagagcagcaaacagaaggagacagagagtcttcatattgccactgccggtctggaacagcagttagcttttatcagagagaatactgcacgtatagaagaagaactggtcaaatttaaggaagaacaggaaagtctggtgaataatcaggatcatgcatcacaggagatatgtgagaaagagaaaaagattcgggatatcagactcaccattgaagattccaaagatcttttcgctgagattgaagcagagattgagaaatcagttcatgaacgcgaagaactgaacagacgtcacaagtcttttctaaagaaacgcgaggatctgtccggacgtatgtcagatctggataaagaaattttccgtctggaaagtcgtaaggaaagttatgaagaggctgctgacaagcagatcaattatatgtgggaagagtatgagctgacttatagccatgctctggaactgcgcaacgagaatctgacagatctggcgatgatgaagaaagagattcagacactgaaaagtgagatcaaagcactgggaccggtgaatgtcaatgctattgaagatttcaagaatctgtccgagcgatatgattttttgaaaggtcagcatgatgatctggtggaagcagaagcaacactggtgaagattattgatgaattggatgaggcgatgcgcagacagtttaccgagcagtttgcacggattgccaaggagtttgatcttgtatttaaagaactttttggcggcggcaagggcacgctggaactgatggaggatgaggatattctggaagcgggtatccgtatcattgcgcagccaccgggcaagaaactgcagaatatgatgcagctttccggtggggaaaaggcactgacggcaatctcgttgttatttgctattcagaacctgaaaccatcaccgttctgtctgttggatgagattgaggctgcgctggatgattctaatgtcaccagatacgcccggtatctccacaagctgacagagcatacacagtttattgtaattacccacagacgaggtacgatgacagcggcagaccgtctgtatggaatcaccatgcaggaaaaaggtgtgtccacactggtatccgtaagtctgctggaggatgaattagataagtaa

SEQ ID NO: 2437 - DNA, 3198 bp, Dorea sp.
atgcctaggataaaagatattaaaaaagtacttgtaatcggatcgggaccaattgtaatcggtcaggcagcagaatttgattatgcaggaacacaggcatgtcgttctctgaaagaagagggagtagaggttgtcttactgaactctaaccctgcaactattatgaccgataaggacattgcagaccgtgtatatatcgagccgctgaccgtagaagtagtagagcagctgataaagaaagagaagccggacagtgtacttcctacactgggcggacaggctgcgcttaaccttgctatggagcttgaggaagctggtttcttaaaagagaataacgtacgtctgatcggtactacatctgagacgatcaagaaagccgaagaccgtctggaatttaagaagaccatggagaagatcggtgagccatgtgcagcttcactggtcgttgaaaatgtggaagacggcgtccagttcgctgagagcatcggatatccggttgtgttaagacctgcttatacactgggcggaagcggcggcggtatcgctcacgacagagtacagttggtggaaattctggaaaacggacttcgcttgtctcgtgttggtcaggtactggtagagcgatgcatcgcaggatggaaagagatcgagtacgaggtaatgcgtgacagcaacggtaactgcattactgtatgtaatatggaaaatattgatccggttggtgtacataccggagacagtatcgtagtagcaccttctcagacactgggtgataaagagtatcagatgctgcgtacatctgcactgaatatcatcagtgaactgaatattaccggtggatgtaatgtgcagtatgcgctgcatccggatacattcgaatactgtgtaatcgaggttaaccctcgtgtgagccgttcttctgcgctggcatctaaggcaacaggatatccgattgctaaggttgctgctaaaattgcacttggttacacacttgatgagatcaagaacgcagttactaagaagacttatgcaagttttgagccgatgctggactactgtgtagttaagatcccgcgtctgccatttgataaatttatcagtgcaaagagaacactgacaactcagatgaaagctaccggagaggttatgagtatctgtgataactttgaaggagcgctgatgaaagctatccgttctctggagcagcatgtggacagtctgatgtcttatgattattcttatctgacaggagaggaacttctggaagtattgaaggttgtagatgacagacgtatctggaagatcgcagaagcaattcgtcaggggatcagctatgatgagattcacagagtgaccaagattgataaatggtttatcgacaagattgcacatctggtagagatagagcttcagatgaagcgcagcgcactggatgaggatctgcttcgtgaagcgaaacgtatggagttcccagataatgtgattgctgagattacaggacacactgagcgtgagattcatgacatgcgccatcagtatggcattactgcagcatataagatggtagatacctgtgcggcagagttcgcagcagagactccatattactattctgtatatggcagtgaaaatgaagtgacagagacgaatgaccgtaagaaggttctggtacttggttctggtccgatccgtatcggtcagggtattgaatttgacttctgttctgtacactgtacctgggcatttgcaaaagaaggctatgaaacaattatcgtaaataataacccggagacggtaagtacagactttgatattgcagacaagctgtattttgagcctttgacaccggaagatgtagaaagcattgtagatcttgaaaaaccggacggagcagtagtacagtttggcggacagacagcgatcaagctgacagagtctctgatgaagatgggcgtgtcgatccttggtacatctgctgagaacgtagatgcagcagaggacagagagctcttcgatgagatccttgagaagtgtgaaattccaagaccgaccggcggtactgtatttacagcggaggaagcaaaagaagttgcgaaccgtctgggatacccggttctggtaagaccgtcttacgtacttggcggacagggtatgcagattgcaattgatgatcacgatgtggatgaatttattggtattattaaccgtatcgcacaggatcatccaatcctggtagataaatatctgcagggcaaggaaattgaggtcgatgccgtatgcgatggcgaagatatcctgattcctggtatcatggaacatatagagagagcaggtatccattccggagacagtatttctgtatatcctgcaaagagtattacagagaagacaaagaagacgattgaagagtacacaaagagactcgcacagtctctacacgtaattggtctgattaacatccagttcattgtatgtggagaagatgtgtatgtaattgaggtgaacccgagatccagccgtaccgtaccgtatatcagtaaggttaccggtattccgattgttccgcttgcatcaaaagttattatgggacataagatcaaagatcttggatatacaccgggattgcagccggaagcagattactttgcagtgaagatgcctgtattctcctttgagaagatccgtgatgcagatatcagccttggaccagagatgaagtctaccggagagtgtctgggtattgcaaagacatttgatgaggcattgtacaaggcattccttggtgcaggaatcaagcttccgaagtttaagaatatgatcatgacagtaaaggatgaagataaagaagaagctgttgagatcggacgcagatttgctgagatcggatataaaatctttgctacggcaggaacagcagagactctgaagaatgccggagtaaaggcaatcgctgtcaataagatcgaacaggaatctccgaacctgatggatctgatccttggacacaagatcgatctggttatcgatacaccgccacagggagtagagcactctaaggatggttttgtgattcgcagaagcgcaattgagacaggagtcaatgtactgactgcgattgatacagccaaggcgttgatcaccagtctggagaacacagatattaagaaactgacattgattgatattgcaaaattatag

SEQ ID NO: 2438 - DNA, 2244 bp, Dorea sp.
gtgattgaattgaaaaagcttcattttaagctacatctgaaaaaaccaaaaaagccggatattaaggggacaatctataagatccggcacctaaaaaaagaagacattattgcctggagaaaggcgaagaaagagcgcagggagcggatcttggaagagcgcaggaacagcgcatttgcgaaaaagatgaagccggtttatatgtggatgaaccggctgtcactcctgtgccatgcactgcttgcatgtgtgatcaatctggttatcgaagccatatccagacattctctgtttcaggcatgggattatatggtaaattcaccactggtgttcctgtataatgcattcatgatatttgcgacattttcaatcgtctatctgttccgacgacgggtatttgccagaattattgtaagtgtattgtggctgatccttggtgtctgcaacggctatatgctgatcaagcgtgtaacaccgtttaatgcgcaggacttaaaggtagcgatggacgcagttcagttgatcaataactactttgatccatttgagctgattatgatcgtggttggtatcgtggcggttgtggtatggatcatatccatgtggcgccgcggcggacagtacacaggtaagcttcgcagatggctggcagtgatcggtatcggagtcagcttcggagcatatctgatcgtcagccagattgcactggatcagcgtgtggtatctaactatttcggaaatattgcatttgcttatcaggattatggtcttccatattgttttatggccagtgtgtttaacacaggcattgatgagccgacaggctacagtaaagaggaaatggagaggatcagcaataacggtgagattacagtcaatgagacctcccgtgcatcagatgatctgccgaatatcatcttcgtgcagttagagtcttattttgatgtagatgaggcagaattttttacaacatctgaggatgcatgcccgaatctgcatgagatgtataagaattattcgtccggatatttcaaggtgccatccgtaggcgccggaaccgcgaataccgagtttgaggttatgaccggtatgaatatgcgtttcttcggaccgggagaatatccatttaagacttatctgaaagaaaagactgcggaaagtgcggcaacagcactgggcgcattgggatatggaactcatggattgcataataacggtggtaacttctatagccgtgcccgtgtatacaacaatgccggatatgatacatttaccagtaaggaatttatgaatatcctgcagaccacaccgaatggatggtcgaaagatgaagtgctgattcagcacatgatggaagcaatggacactaccgagcagcaggatttcctgatgaccatcagcgtacagggacatggtgattatccggaagagcaggtcatcgaagacccgaagattaaggttgagggaatcgagaacgaggcactgaagaataaatgggaatactatgtgaatcaggtctatgagatggataagtttgcaggggatctggtaaaagcagtggaagaccgtggcgaaccgacagtgatcgtattctatggagaccatctgccgaccatgggactgcaggcagaagacttaaagagccgttacctgtacaacaccaattacgtaatatgggataacattggtttggagcagcaggataagaacattcctgcatatcagatcatgtcagaggtatttgaacgtctgggcatccattccggaacgatctttaactaccatcaggaacggaaaggtacaaagaattatctgtccgacctggaactcctgcagtacgatattctgtacggcaagcagtatgtctataatggtaatccgccaatcacggaaggacatatgcagatgggcgtgaaggatgtaacattgtctgagatcgtaccgcatctggagagcggatacagtttgtatggtgagaactttaccaagagcagtaaggtctatgtcaatggtgagaagcagaagagtacattcctgaacaatacacgaattgaactgccggatacttctgatctgcagtatggtgacattatcacggtcagtcaggtgggatcaagcaatacggtattccgtacatccaatgagtatgtatatcagaatggacagttgattgaaaagccggataccggaagcggcatcgaaggcaaatcatggcttgagacaacgaaagaacaaggggattaa

SEQ ID NO: 2439 - DNA, 2448 bp, Dorea sp.
atgaagaaaaaagcgatacacgtcggcgtactggcggcgatatttatcatcgcagtcgtcgtatttgaatatatgaccactcgtggtaacgatgatatgatggaagatctcggcaatgccgtactacctcgggtgtattttaccgtagatggatatggagtcaatgcgttaaatgcttattcggaagagatggatattaccacaatgcgggattctgtcacgccgatcaatggtaagaagctgacgatgaatctggaagcggacgagacaaaagtaaccgcagttgattatgctgtctatacattggacggtaaaaagaaactgagcgaggataagatcagtaaggtaaaagatcagatggatctgagctttgatcagaatctgctgtcagaagagcggatgctggtgcttaccctgcatgcagacggcaagtctgtttattactatacaagaattgtgaatccgacggactttaatctgacggattgcctggattacgtatataattttcatgagaatgccttgaaaaaggtggagaatgcaggcgtaggagcagcactggagcaggatgatgaggatgccaattctacattttcccatgtgaccattcattcatcatacgatcaggtgacctgggggaatcttgcaccacaggtgacaggcggtgaacgctggaagattacagagaccaacagttcttatacatccgtgcttctggaatacgatgtaagctgtaccggagaagagaatgagacggatatgtatacggtcagagaatttttccgcgtgcgcaagaataacggacagatgtatctgttgaattatgaccgtacaatggaacagatctttgacggaagtaagaatgtattgagtgaaaaaggaatcctgcttggaattactgatccggatgttccgtatgtggttagttctgacggcaagattgtagcatttgtgcaggcggatgagctgtggaattatgacaaagagcaggatcagctttcgctgttgttcagttttcgtgatgcggaaaatgcggatgtccgtaataaggtatcggatcataagatccagattctgaatatggacaaaaaaggcaatacaacattttcggtatccggatatatgaaccgcggcgaacacgaaggatatgtgggagttgccgtttattactataatatcgagaccaacagtattgaagaaaaggcattcgtatccagcaacaaatcagctgcaatcgcgggaagtgaactggatacgttgaaatattataataccaagacgaataagctatacatgctggcagacggggcacttcatgagatcagtattaagaaggattatgatgaagtgctgcttgatggattgaaagatggtcagtatgtggtatcagataatggtaaatggctggcatatcagacaggtgatgatgtgatatcttcgacagaagtgacggtcatgaatctgtcggatggcagtgaatatcaggtaaagagtgcagacgatgagtgtatgattccacttggatttgtgggcaatgatttcgtgtcaggtctggcgaaacttgatgatatcggtaagaccatcagcggtgaacaggctattgtaatgtatcagatcgagatccgcagtgatgcagacaaggtcattaagacttacagcagtgatggttattacattttaagcacggagattgacgacggaatgatcacgctgaaccgcgtccagaagaatggcgatacctatacatcggcggcagcagattatatttccagcaatcaggaaaagaaagaaagcaatatcatgctggaatcttatgtgacagatctgaaggagacacagatgcgtctgacttatgcggatggcatcaaggacaaatctgcgaaagtattgaagccgaaacaggttgtacaggacgaaccagcattaccgtcttttggtaaagaagtaaaagaaaacggttattatgtatatggaaccggacagctccagggtatctacaaaacagctggagaagccatccgcaaagcggacagtgtcagcggagtcgtcattgacgcaaaaggacagtacgtatgggagcgtggcaaccgttatctggtctatgatctgtccaccagtcaggcgtcagcgatcagtgaactgcagaatgcacttgcatccggtacatcggcgctggaggcagctggtaatatgtcagatcagaaagtgctggaacttacaggatgcacagttgaagaaatgttgtatctgatcaacaaggatacaccggtcatcggtgtgcgtaacggagcttctgcgatcattctgacaggatacgatgaaagtcatgtgacttatgtggattcggagaacggcgagagcaagaccgtgacgcaggaagagatggatcagatcatgcagagcagcggcaatgcatatgtgggatatctgaagaaggcagaagagtaa

SEQ ID NO: 2440 - DNA, 2553 bp, Dorea sp.
cggggaatcatcagaagacgggaactggtcgatgatgctaccaaagagctggatcaggcgaagatagatctgaaagagggaaaagcgaaggcagaacaggaattatcagatgcggagacacagatagcggatgcagaaagtcagctggcagatgcgaaagaaaagatcagaagcggcagggctcagatagaggaagcaaagaatacgctgacacagaaacagcaggagctggatcaggcaaaaacacaatatgcagatggtgtgcagcaattacaggatggacgtgctcaatatgaagcagggaagactgcatttgaagcaggaaagccagaggcagaacagaagattacagaaggcgaagcagctcttgaacagatccaggcggggattgatatctgcaataatggattagaggcacttaaagatatgtgtggtaatgatgaatccatttatggaaatccggatacagagataggagcacaatacgctggactggtgcagcagctggagggattggagcagcagaaaacagaactttcagctcagctgcagatggcaaaagatcagctcgcttctgcggaacagcaattttcagatacgaaggccgcactggatgcatctgaggcagcgctggcgtcagtaccggcgcagctgacaagtggacaggagcagattaatgccggctggcaggaactgtctgagaaggaacaggaactggaaaaagggatgtctgagattacggaaaatgagaataagatctcagatgcaaaacaagatttggaagaaggcagaacaaaagcagcacaggatattgcggatggggaagataagattgcagatggtgagaaaaagatcgatgatatcccggaggcagaatggtatatttatgacagaagtacattgccggagtacaatggttatggggagaatgcagatcggatgaaggctataggaaaagtcttcccggtattgttcttcttggtagccgctctgatcagtcttaccggtatgactcgtatggtagaagaacaacgagtacagattggtacgatgaaagcacttggatatcgcagatcaaccattgctatgaagtatattggttatgcgtttttggcaactatcaccggaagtattctcggagtgttggttggtgagaagattttgccgtatataatcatttattcatatggtattttatatcatcacattccggagattctggtgccatatgtgccgtcatacggtattatggcatcggcagcagcaattgcgtgcactttgatggcaacaatttttgcctgctataaggaactgggagcacagccgtctgagctgatgcgtcctccggctcctaaagtaggaaaaagggttttcctggaacggattccgtttatatggaaacgattgaatttctcgtggaaatctacagtgcgcaatttgatgcgttataaaaagcgcttctttatgacgatatttggtattggtggctgtatggcgctgatgatcgtgggatatggacttagggattctgtatatgagattgcagatatccagtattctgagatccagctttatgacggtcagatcgtgctgcaggaagatttgaatgagcaggatcgagaacacctgaatacatttttggatacggacaaagacgtagaatcttatatggatgcttatatgaagagcattacacttaagaatggaaagaaagagcgtcaggcttacattacggtgtttggagatgtgaaaaatataggacggtatgtagattttcacgaccggaaatcaggtgagaaatacaaactgacagatgatggcgtgatcatcagtgaaaagactgctaagcttctaaacgctaaagtgggagatcatatcacgattccggatgagaaaaacggcgataaagaacttaccatttctcatatatgtgagaattatatgggacattatatctatatgacaccagcttattataataaggtatttggtacaatgccggagtataacagtgttttgtttgaaacggatgattcttatagccagacacaggtagaagacgttggcgagaagattatgaaacgggatgaagttttaagtatcagctatgttcatgatattcaggaacagttggatgaaatgctgtccagccttaatcttgttattattgtattgatcatttcagcaggaatgttggcatttgttgtactttataatcttaatacgatcaatatcacagagcggcagcgggaattagctacattgaaggtattgggattctacgacggagaagtggcacagtatgtattccgtgagaatattttgttgacgtttatcggcgcagcagtgggtgttgtgcttggcaaggttcttcatttgtttacgattcagacggtggaagtagatgcagctatgtttggacgtagtatctatctgccgagttttatttatagtctgttgtttactgtgggattttcattgttgatcaactggatcatgtattttaaactgaagaagatcaatatggtggagtccttgaagagcgtagagtaa

SEQ ID NO: 2441 - DNA, 2640 bp, Dorea sp.
atgcagaagtacggagtaaacgaactgagaaagatgtttctggagttctttgagagcaagggacatcttgcaatgaagagtttttcactggtgcctcataatgataagagtctgcttcttatcaattctggtatggcaccgcttaaaccatattttacaggacaggagatcccaccgagaacaagagtaactacatgtcagaaatgtattcgtaccggagatattgagaatgtaggtaagactgcacgacacggtacatttttcgagatgctgggtaacttttcgtttggtgattactttaagaatgaagcaatccactggacatgggaattcctgacagaagtagtaggtctggatgctgacagactgtatccatctatctatttagaggatgatgaggcatttgagatctggaacaagcagattggtattccggaggaacgtatcttccgttttggtaaagaagataacttctgggagcacggttcaggtccatgcggtccgtgttcagaggtatattatgaccgtggtgagaaatacggctgcggcaagcctggatgtacggtaggttgtgaatgtgaccgttacatggagatctggaacaacgtatttacccagttcgataatgacggtcatggtaattatacagagttagagcagaagaacattgataccggtatgggactggaacgtctggcatgtatcgtgcaggatgtagattctatgtttgatattgatacgttattcgcactgcgtcagcatgtatgtagtatggctggtgttgaatacggcaaggatgatcagacagatgtgtctattcgtgttattacagaccatatccgttctgtaacatttatgatttcagatggtattctgccttccaacagtggacgtggatacgttcttagaagattgctcagaagagcatgtcgccatggaagactgcttggtatcaaaggagcattccttgtggaactggcagagaccgttattgaaggttccaaggatggatatccggaactggaagagaagaaagactttatcttcaaggtaatcaccaaggaagaagagcagttcaataagaccatcgatcaggggctttctattcttgcaggaatggaagcagagatggcaaagaagggcgagacagtacttgccggagaagaggcgttccgtctatatgacacttatggattccctgtagatctgaccaaggagatcctggaagaaaagggaatgcagattgatgaagaaggctttaagaaagctatggaggctcagcgtgagactgccaaaggtacgttcggtgagcataactatatgggagcagatgtgacgatttacgaatctattgatccatctgtaacgacagagtttgtgggatatgatcatacagagtatgagtctccggtaacggttctgactaccgaagatgagattgtagatgcattgtctgatggtgacaggggaacaatcttcgtagagaagactccattttacgctaccagcggtggacagcaggcagataccggtgtgatccgcacagcagattttgaattccaggtagaggatgtgaagaaacttctgggtggcaagatcgctcatgtcggacatgttgccagaggtatggtaaaagttggtgatacagtaacacttgagattgacaaagagaagagagcactgtctggaagaaaccacagcgctacccatctgttacagagagcactgcgtaatgtgcttggcaaccatgtagaacaggccggttcttatgtggatgagcacagactgcgtttcgactttacacatttttcagcgatgacaccagaagaactggagaaagtagagcagatcgtcaatgaacagatccgcgcacatcttccggttaaggttgaaaatatgccgatcgaagaggcaagaaaaacaggggcagctgcattgttcggtgagaaatatggtgatattgtacgtgttgtaagcatgggtgatttctctatcgaattctgtggcggtactcatgtggagaatacaggtgtgatcaatgcattcaagatcatttccgaaacaggtgtagcagcaggcgtgcgtcgtattgaagcactgacatctgacggactgctggcttactatgatgagacagagaagaagcttgaggaagcagctaagatcctgaagacaacgccggatcagttggcagagaagctgactcaccttcttgcggagaataagtcactgaagtctgagctggaaagtgctaagagccagcttgcaaagaacgctcttggggatgttatggatcaggttgtcgaagtaaatggcgtgaagttcctggctgctcatatttcaggagtcgatatgaatgaattgcgtgaacagggcgaccagttgaaagaaaagcttggagaaggtgtactccttctggcatctgatgtaaatggtaaggttaatctggtagctatggcaacagacggagccatggctaaaggagcacatgcaggcaagctgatcaaagaagtcgcagctgtagtaggcggtggcggcggtggccgtccgaatatggcacaggctggtggtaagaatccggcaggaattactgacgcacttagcaaagcgaaggcagttctggagagtcagcttgcatag

SEQ ID NO: 2442 - DNA, 2487 bp, Dorea sp.
atggaagacaatatttttgataaggttcatgaggtggacctgaaaaaaacaatggagacttcttatatcgactatgctatgagtgttattgcttctcgtgcactgccggatgtaagagatggattgaagccggttcagcgaagaattctgtattcaatgatcgagttgaataacgggcccgacaaaccgcacagaaagagtgcacgtattgtcggagatacaatgggtaaatatcatccgcacggtgacagttctatttatggcgcattggtaaatatggcacaggaatggtctaccagatatccattagttgatggacatggtaacttcggttctgtagacggtgacggtgcagctgctatgcgatataccgaagctcgtctgagtaagatttctatggaactgacagcggatatcaacaaagatacggttgactttatgccgaactttgatgagacggaaaaggaaccggttgttcttccgtcaagatttcctaatcttctcgtaaatggtacttccggtattgcagtaggtatggcaaccaacattccaccgcataatctgcgtgaagttatcaatgcagttgttaaaattatcgatgaccagattgaggataaagatgagacagcaattgaagaaattttgaatattatcaaaggacctgattttccgacaggtgctatgatccttggtactcgcggtatagaggaagcatatcgtaccggacgtggtaagattcgtgtgcgtgcagtgactaatatcgagccgatggcaaatggcaagaaccgtattgtggtaacagaacttccatatatggttaataaagcacgccttattgagaagattgcagagatggtaagagataagagaattgatggaattactgatctgagcgaccagtccagccgagaaggtatgagaatctgtattgaactcagaagagatgtgaatccaaatgttatcttaaaccagctatacaaacatacacagttacaggatacttatggcgtgatcatgctggcactggtcaataaccagccgaaggttatgaatattctggacatgctgacatattatcttcagcatcaggaagaagtcgtaactagaagaacgaagtatgaattaaataaagcagaagagcgtgctcatattttacagggattattgattgcactggatcatattgatgaagtcattcgtattatcagaagctctgcaaatgtgcaggctgccaaggcagaattgatcaaacagtttaatctgtctgatgtacaggctcaggctattgtggatatgcgtctgcgtgctcttaccggtttggaaagagagaaaatcgagaatgagtacaaagaactgatggagaagattaaacatttgaaagcaatacttgcagataaaaagcttcttcttggtgtaatcaaagaagaaattcttctgatccgtgacaaatatggtgatgagagaagaacatctataggatttgatgaatatgatatttccatggaagatctgattccaaaagaggatgtagtaattactatgacaaaaatgggatatatcaagagaatgtctaatgacacattcaaagcacagaatcgtggtggtaagggaatcaaaggaatgcagaccattgatgaagattatgtggaagagttatttatgacacatactcatcattatattatgttctttaccaataagggacgtgcataccgtctgaaagcatatgagattccggaggcatcaagaacatccagaggaacagcaattatcaatcttcttcaactgatgccggaagaaaaaatcagtgcagttattccaattgatgaatatcgtgatggtgagtatattgttatggctactgcaaaaggtctggtgaagaagactccggttacggatttctctaatatccgtaagaatggtcttgctgcaattacactgcgggaagaggatgaattgattgaagttaagtttacagatggtaatcaggaaattattctggcaactaaatttggtcagtgtatccgttttgcggaaacagatgtaagaaccacaggaagaacttctatgggtgtacgtggtattaacctggatgacacagatgaagtaattggtatgcagcttgcaactcagggcaatgagcttttgatcgtatctgaaaagggtatgggaaaacgtacactgatcagtgactttagtgcacagaatcgtggtggtaaaggtgtgaagtgctacaagattacagaaaagacaggtaatgttgtaggtattaaggcaataaatgaggatgacgagattatgatcatcaacacagaaggtattgtaatccgtatgttctgcgagggtatttctatccttggaagaatcacatctggcgtaaaactcattaatctgaaagacggagtgaccgttgcaagcattgcaaaagtaagaaaagaagaagaaattgaagaaccaacagaagagactgaagattcagaagagtaa

SEQ ID NO: 2443 - DNA, 2565 bp, Dorea sp.
atgggcttattacaaaagttgtttggaacacatagtgaaaatgaattaaagcgaatttatcctatcgtggatcgcatagaagcactggagccggagatgcagaagctgtcggatgcagagcttcgggacaaaacccgtgaatacaaagaacgttatgcagaaggagagtctttggatgacctgcttccagaggcgtacgcgacggtgagagaggcgtctgtcagagtacttggcatgcgtcatttccgtgtacagttagtcggcggtgtcgttcttcatcagggacgtatcgctgagatgaaaactggtgaaggtaagacactggtatctacccttccggcatatctgaatgcattgacaggagaaggcgtacatatcgttacggtcaatgactatctggcaaagcgtgactcagagtggatgggacaggtacatgaatttctgggactgacagtcggcgtagtactgaacagtatggacaaagaagaacgtcgtgctgcttataactgcgacattacttacgtaacaaataacgaactcggatttgactatctgagagataacatggtcatttacaaggaacagctggtacagcgcggtatgaagtttgctgttatcgatgaggttgactctgtattgatcgatgaagcacgtacaccactgatcatttccggacagagcggcaagtcaacgaagctttatgaagcatgtgacattcttgcaagacagatggaaaaaggtgaagccagcggagagttctctaagatcaacgccatcatgggagaagagattgaggaaaccggagactttatcgtagatgagaaggaaaagaacatcaacctgacagaagatggtgtgaagaaggtagagaagttcttccatctggacaatctggctgatccggagaacctggaaatccagcataacattatcctggcactccgtgcgcataacctgatgttccgtgaccaggattatgtggttaaggatgatgaagtactgatcgtagatgaatttaccggacgtatcatgccgggacgccgttattctgatggtctgcatcaggcgattgaggcgaaggaacatgtaaaggtgaaacgtgagagtaagacgctggcgaccattacattccagaacctgtttaataaatacgagaagaagagtggtatgacaggtaccgcgctgacagaggagaaggagttccgtgagatctacggaatggacgttgtagaaatcccgaccaataagccggtcatccgtcaggatctggatgatgccgtatataagacgcagaaagaaaaatacagagcagtctgcgatgcagtagaagaagcacatgccaaaggacagccggtgctggttggtacgatcacgatcgaggtatcggaacttctgagtggtatgctgaagcgaagaggtgtacagcataatgtattgaatgccaagtttcatgagatggaagctgagattgtagcgcaggcaggtcagcatggagcagtaacgattgctactaatatggccggtcgtggtacggatattaagctggacgatgcggcaagaaaagccggcggtcttaagatcatcggtacagagcgtcatgagtccagacgtattgacaatcagctccgtggacgtgccggacgacagggagatccgggtgaatccagattctatatttctctggaagatgatctgatgcgtttgtttggttctgaacgtctgatgagcgtgtttaatgcacttggtgtagaagatggcgaacagattgagcataagatgttatccagtgcaatcgagaaggcacaggagaagattgagaataacaactttggtattcgtaagaacctgttggaatatgatcaggtaatgaatgagcagagagagatcatctactctgagaggaagaaggttctggacggcgagagcatgcgtgattctatcatccatatgatcacagaatatgtggagaatctggtagacagtgatattcctgcagatgcagatccggaagactgggatctggtgaactttaatgtaagcctctgtaatgtgatcccgatgaagccggttgcaccggaagaagttaaggatatgaatgccaagaagctgaagcatatgctgaaagagcgtgcggtgaagctgtatgagcagaaagaagcagagttcccggaaccggagcatatccgtgaactggagcgagtggttcttttgaaggttatcgataataaatggatggatcacatcgatgacatggatcagctgcgtcagggtattggattgcaggcatatggtcagagagatccgaaggttgagtacaagatgatcggatatgagatgtttgatgagatgacaagagcaatttctgctgatacgatccgtgcattataccgtgtgaagattgagcagaaggcagaacgcgaagaagtagccaaggtaaccggtacgaataaggatgaaagtgccgtacgtgcaccgaagaagcgtgaaaataagaagatctatccaaatgatccatgtccatgtggaagcggtaagaagtataaacagtgctgcggacgtaaataa

SEQ ID NO: 2444 - DNA, 2190 bp, Dorea sp.
atggatattcaggttaagacaaaggtcatcaaacgtaatggagaagaggtgaattttgatcttaccaagatcgagaatgcgattaataaagcgaatgctgaggttgacaatatttacaagatgaacgagtatcagattcgtgccatcgcagacgatattgcacagcaggttggtgagatgcgtcacgcagttcatgtggaggatatccaggatatggtggagaccagcattatgggaatgcgtggatacgaagtagcgcagaagtatgtgcgttaccgttataagagagaacttgcccgtaagtcgaatacaacagataatggaattcttgcgttgatcgagcatgtgaatgaggaagtgaaccaggagaattctaataaaaacccggtgatcaactctacacagcgtgattatatggcaggggaggtcagcaaggatctgaccaagcgagttttgcttccggaagatatcgtacaggcgcatgagcagggcgtgatccatttccatgattcggattattttgcacagaaggaacacaactgtgatctgatcaatctggaggacatgcttcagaatggtaccgttatcagtgagacattgattgagaagccgcacagcttctttactgcatgtaatgttacgacacagatcgtggcacaggtagcaagtaatcagtatggcggacagtcatttacactggcacacctggcaccgtttgtggatatcagtcgtcagaaattgaaaaatatcgtgatccgcgagcgcaaggaatgtggtgaaagcctggatgagaagattatcgagaagcttactgagagccgactgaaggatgagattaagagtggtatccagaccattcagtatcagttgatcacattgatgacctgtaacggtcaggcaccgtttgtaactatgttcatgtatttggatgaagtaccggaaggcaagaccagagatgaccttgcgatgatcattgaagaagtaatgaaacagagaatgcagggcgtcaagaatgaaaaaggtgtatggatcacacctgcattcccgaagctgatctatgtactggacgaagataatattacagaagattccaagtactggtatctgacagaactggctgcaagatgtacagctaagcgtatggtaccggattatatttctgccaaggttatgaaggagctgaaacagggcaatgtatatccttgtatgggatgccgttcattcctgacagtagaggatgcccagcgcaatcctgatggaagtcacaagttctatggccgttttaatcagggcgtggttacaatcaatctggtggatgtggcctgttctgcagagggaaatatggatcgtttctgggcaatcctggaagagagactggaactgtgtcatcgtgcacttcgttatcgtcatgagagactgcttggcacaatttctgatgtggctccgattttatggcagtatggagcactgtccagactgaagaagggcgagactatcgataagctgttatacaatggatattctaccatttcactgggatatgccggattgtatgagatgtgcgtccgcatgacgggtaagtcacacacagacccggacggaagagcatttgcggtcagtgttatgcagaagctgaatgataaatgtaaagaatggaaagaagcagagcatatcagctattcagtatatggtactccgatggagtctaccacatacaaattcgccaaatgcttacagaagagattcggtatcatcaagggtgtaactgataagaactatattacgaacagttatcacgttcatgtaactgaggaaatcaatgcatttgacaaactgaaatttgaagcagattttcagaagctgtctccgggaggtgcgatcagctacattgaagtaccggatatgcagcagaatatcccggcagtgctttctgttatgaagtttatttatgagaacatcatgtatgcagaactgaataccaagagtgattactgtgagtgctgcggttatgacggagagatccagattaaggaagacgagtctggcaagctggtctgggaatgcccgaactgtggtaatacagatcagaacaagatggcagtagccagaagaacctgtggttatatcggaacccagttctggaatcagggaagaacccaggagatcaaagaccgagtattacatttataa

SEQ ID NO: 2445 - DNA, 2229 bp, Dorea sp.
atgtttatgaaatcacttgttttagcagagaaaccttcggtagcccgtgatattgcgcgggtgctgaaatgtaataagaatattccgggtgccatcgagggcagtcagtatattgtgacctgggcactgggacatctggtaacactggcagatccggaagaatatgataagaaatttaaagaatggaatatgtcgtatctgccgatgatgccggaaaaatgggaattagttgtaattcgccagacagcaaagcagtatcggaatgtgaagacccagctgttccgaaaggatgtatcggagattatcattgcaacggatgccggtcgggaaggcgagctagttgccagatggatcctggataaatccggttgtcacaagccgattaagagattgtggatatcttcggtaacagacaaggcgatccgtgaaggatttgaacatctgaaagatggcagacagtacaatgcactgtatcatgcggcaaagagccgtgcagaagcagactggctggtgggaatcaatgcaacccgtgcactgacctgcaagtataacgcgcagttatcctgtggtcgtgtgcagaccccgacactggcgatgatcgcacgcagggaagaagaaatccgtgcatttaagccggaagattattatggcttacagtgtatggcaggaggcgtgaaatggacctggcagaatgcaaagaccggaagcctcaggtcatttaagaaggaagttattgatcagatagaaaagagcattaaggggcagaaactggtcattacggatgtgcagaagcaggcaaagaagaagtcgtctccgggtctttatgatctgacggaacttcagagagatgccaataagcggtatggattctcggcgaaggagacgcttaatatcatgcagcgtctgtatgagcatcataaggtattgacgtatccaagaaccgattccagatatatcggttcggatattgtgccaaccatcaaagaacggttaaaagcctgcaatatcggaccgtataaagcatatattccagcacttttgaaggcaccgatctgtacaagcaaagcatttgtggatgataagaaggtcagtgatcaccatgcgatcattccgacggaagaatacgtacaattagatcgcatgagtaatgaagaacggaagatttacgatctggtagtacgccgttttatcggtgtactgtatccggcatatgagtatgaacagacgacgatgaaagctactgtgcaaacatctgcgaagccatctgtggctaccgcggtatttggggcgaaagggcaggttgtattgaaagaaggctggaaagcggtctatgacaatatgtctctggatgaggaagaagatgataaaagcggggatcagctgagattagcagggcagcagcttccgacactgaaaaaaggtcaggaagtagatatttcccaaattatgcggtcgcagggaaagacgaagccaccggcaagatttactgaggcaaccctgctgagtgcgatggagaatccggtccgttatatggagtctgataatgtcaaagagcggaaaacactgggcgaaacaggtggtctcggaacggtagcaacccgagcagatattatcgaaaagctattccatacgtttttgatagaaaagaatggcaatgagatccggatcacatcaaagggaaaacaactgctagaattagtgccggaagacctgaagaaaccggaactgacagccagatgggaaatgcagttgtcggacattgccgctggaaatgggaaagaaaagacatttcttcatgagatcaaagattacacaaaagacttgattcaggagattaagcaggcagatggaactttccgtcacgataatctgacgaacagcaaatgtccgcgttgcgggaagaggatgctggcagttaaaggtaagaatgcgaggcttctggtgtgccaggacagagaatgtggttataaagagacggtagcaagaaccagcaatgcgagatgtccaaactgtcataaaaaaatggaattgatcaagaaaggcgatgcagagacatttgtgtgcacatgtggatataaggaaaagctggaggcatttaaggcgagaagagccaaagaaggtgcaggcgtgtccaaaaaagatgtgcagaagtatctgaaaaagcagaaagaggaaccggtgaacaatgcatttgcacaggcactggcgggaataaaactggatgaataa

SEQ ID NO: 2446 - DNA, 2847 bp, Dorea sp.
atgtcaaaagtaaaagtatatgaacttgcaaaggaacttggcaaggacagcaaagacgttgtgaagttcctggaaggaaagaatatagaagtaaagaatcatatgagcacgatttcagaggatgaagccgctatggtgaagaaagcacttggcggaagcaaagcccctgcatcaggggatgaggctaaggcagcaccgaagaagaaaaatatcgtgcatgtattccgcccgcagaataccagagatggttccagaaatggcagacgtcaggccgggcgtcctgccggtggagcaaaggcaccgcagaatgcaaagccgatgcaggtacagaacggaagaccggcaccgggaagcaagccggcagtaaaacctgtcactaagccagcagttaagcctgtagcagagaagccggcagaagcagtaaagcctgcagaggtgaaaccagaagtaaatgcagagacagtacaggctaagaagccggaaagtactccggtacagccgcagagtgtggcgtaccagacagaaaaagttcaggagaagaatacgtcagtggaaaaaccagttaagaacagagaagaacagaatagaaattctcaatcccaggaaggacgcagagagcgttcacaggggggatataacagagaccgtcagggaagaaatgacagaaataatgaccgcggtgacagaaacggtcgcccacagggagacagaagagataataaccgcggaagaaacgacagaaataacgatagaaatgatcgcccgcagggagacagaagagataataaccgcggaagaaatgacagaaatgatcgtcagggcggattcaacaacagagaccgacagggaagaaacggaaatgaccgtttccagaacaacgatcaccgcaagaagaataataatcctgcaattcctgcaccggctttggaaggacagaagccacagcagagaaagaataagggcaaggaagacttcaagaagaaagattaccgcaaggatgacgaagacagaatgcctaagggaagaaagcagaagaatgatcagaagcagcagatgcagaagccacagcagaaggaacagaaggtagaagagacaatcaagtcaatcgtaattccagaggtccttacaatcaaagaactggcagataagatgaagatcgtaccatctgttattgttaagaagctctttatgcagggcaagatcgtaactgttaatcaggagattgattatgatacagcagaagagattgcgcttgagtttgatgtactctgcgagaaagaagaagttgtagatgtaattgaagaactcctgaaagaggaagaagaagacgaaaagaagatgaagaaacgtccgccggttgtatgtgttatgggacacgttgaccatggtaagacttctcttctggacgcaatccgccatacaaatgtgatcgaccgtgaggccggtggtattacacagcacattggtgcttctgttgttacagtaaatggtgagaagattacattcctggatacaccgggacatgaggcttttactgcaatgcgtatgcgtggtgcgaactctactgatattgcgattcttgtagttgccgctgatgatggtgtaatgccgcagacggttgaggcgatcaaccatgcgaaagctgcaggtattgaaattgtagttgcgattaacaagattgataagccaagtgcaaatatcgatcgtgtaaaacaggaactgtctgagtacgaactgattccggaggactggggcggaagcacaatcttcgtaccggtatctgctaagaccggagaaggtattcaggatctgatggaaatgctgcttctgacagcagaagtatctgaacttaaggctaatccgaacagaagagcaagaggtcttgtaatcgaggctcagcttgacaaaggtaagggaccggttgctactgttctggtacagaagggtacactgcgtatcggagatgcgatagctgcaggttctgcttacggtaaagtaagagcgatgatggatgataagggacgccgtgtaaaagaggccggtccgtctactccggtagagattcttggtctgaatgacgtgccgaatgccggtgaagtatttgtcggatgcaagaatgacaaagatgcaagaagttttgctgagacatttatctcacagaacaaagctaaacttctggaagatactaagggtaaactttctctggatgatctgtttacacagattaaggaaggtaacctgaaggaactgaatattgtagttaaagcagacgtgcagggatctgtagaggcgatcaagcagagtctcctgaagctgtctaacgaagaagttgtagttaagatcattcatggcggtgttggtgcgatcaacgaatctgacgtcagcctggcatctgcatccaatgcgatcatcatcggatttaacgttcgtccggatgcgaccgccaaagagacagcagagcgtgaaggtgtagatgtacgtctgtatcgtgttatttacaacgctatcgaagatgtacaggcagcgatgaagggtatgctggatccggtatttgaggagaaagtgcttggtcatgccgaagtacgtcagacattcaaggcttccggagtgggtacaattgccggatcttatgtgctggatggtacattcgaaagagattgccaggcaaggatcgtacgtgacggtatcgttatttatgatggcaagcttgcttctctgagaagatttaaggatgatgtaaaagaagtacgtgccggatatgaatgtggtttcgtatttgaaaattataatgatgtaaaagaaggcgaccaggtagaggcgttcaagatggttgagatccctagataa

SEQ ID NO: 2447 - DNA, 2154 bp, Dorea sp.
atggaagatgaagatgggtggaaccacgatagatatatcgtccctgacattgttttaagacagtgccagggacttttttatatgttaaagagggtagaaagtcagaggcatgatcttaaaatcagaagtatctattttatgctcatatacaggagcacacatttttatcatgaggaggaaattaaaatgaagatcacattaaaagacggatctgtcaaagagtatgcagaagcaaaatcagtatatgatattgcatcagacatcagtgcaggtttggcaagagttgcctgtgcaggagaagtgaatggagaaatcgttgatcttagaacagtagtagatcaggattgtgaattgaatattgtaacagccagtgatccggaaggactcagagttatccgtcatacagcatctcacgtgctggctcaggcggttaagagagtgttcccaaatgcaaagatcgccatcggaccggcaatcgacgatggtttctattatgattttgaagcagaaccattttcaagagatgatctggataaactggaagcagagatgaagaagatcatcaaagaaggacatgaattaaagagatttacacttcctagagaagaagcaattgcatttatgaaggagaaagatgagccattcaaggtagagttaatcgaagatctgccggaaggtgaagaaatctcattctatgatcagggagaatttgtagacctgtgtgcaggaccgcacctgatgagcacaaagggcatcaaggcatttaagctgacatcatcatctatggcatactggagaggtgattccgaaaaagcacgtttgcagagaatttatggtactgcatataataagaaagaggaactgaaagcacacctcgagaaaatggaagatgcaaaacgcagagatcacaataaacttggccgtgagatggaattatttacaacggtagatgtgatcggacagggacttccactcttcccaccgaatggaacgaagatgatcatgaagctgcagagatggatcgaggatctggaagataaagagtggggctatgtacgtaccagaactccgctgatggccaaatctgatctgtataagatttccggacactgggatcactacaaagacggaatgttcgtactgggtgatgaggagaaagataaagaagtgtttgcacttcgcccgatgacttgcccatttcagtactatgtatataagaatacacagaagtcatatcgtgatcttccttacagaatgagtgagacatctacactgttccgttcagaggattcaggagaaatgcacggactgacacgagttcgtcagtttacaattactgaggctcacaatgttatccgcccggatcaggctgaagaagaattgaagaactgtctggatctggcatactatgtgctgactacattaggactgcaggatgatgtgacatatcgtctgtctaaatgggatccggctaataaggcgaaataccttggtgatgacaattactggaacagcacacaggatgcgctgcgtgccgtacttcatgagaagaatgtgccattcgtagaggctgacggagaagctgcattctatggtccaaagatcgatattcaggctaagaatgtatatggtaaagaagataccatgatcacaattcagcttgactgtgcgattgctgagaacttcgatttgtattacattgatcagaatggtgagaagaaacgtccttacatcattcacagaacatcgatgggatgctacgaacgtacacttgcatggctgatcgagaaatacgccggcaagttcccgacatggctgtgtccggagcaggtgcgtgtacttcctatttctgaaaaatacgcagactatgcgaatgaagtatgcaaagagttgaagaaaaatgatatcgatgctacagttgataaccgttcagagaagattggattcaagatccgtgaggcaagactggataagctgccatatatgttagtagtcggacagcaggaagaagcagacggaacagtgtctgtaagaagccgttatgcaggtaatgaaggaaccaagccacttgctgagttcatcgatgcaatctgcaaagagatccgtacaaaagagatcagaaaagaattgccggaagaagaaaaggcaaaataa

SEQ ID NO: 2448 - DNA, 2322 bp, Dorea sp.
atgagtaagatagcgaagaatatgcttccatactggaagtcagtgattatcattcttgcgctgctggtggttcaggcgatgtgtgatctggcacttccgtcgtatacttcggacattatcgatgtaggaattcagaacagcggtgtggaacatgtggtgccggagaagataaccgaagaggaattgcagacggcgcagtttattatgacagatgatgaagcagatgtgtggaagaatctgtataaggagaaagacggatattacgaattgaaagatctgtcagaggataagctgaatcaggcagatgaagaactgacggtgccgctgatcatgaattatcagatgagtgcgatggaggtggatacgtttaagaaatccattgctgctcagatgggtatggatgaagcgcagcttgcggacatgtcagttgagcaaattggtcagatgatgcatatggaactggagagtttcatgcaggagaaaaaagatgacgatggtaacacaaagacggtagaatgcgtagatgtacgaggtgtattttctgcgttgttgcagagtggcgcaatgacaaaagaccagattttttctatgcgcgacgatatggaagataccattgatgcaatgggaagctcactggtgaaatcgatgggagttgcctatgcagtatctgctgataaggcagccggtgtggatatcaatcaggtacagaaggattatctctggatgtccggactgaaaatggttggcatggcactgttgatgggagttgttaccgtgctggtaggcttctttgcttctcgtgtgggtgcaggtgtcggaagagatctgagagataaagtatttaagcgtgttgtgaggttctccaatgcagagatggacagattttcaacagcatccctgatcaccagaagtaccaatgatattcagcagattcagatggtgtctacgatgcttctgcgaattgtagcatatgcaccgatccttggtatcggcggcgtgctgaaggtcataaagacgggagcaggaatgggctgggtgatcgcactggcgattattgtgatccttggatatgtaatggtattggtatccgcagctatgccgaaatttaaactgatgcagaaactggtggataacatcaacctggtatcaagagaaatcctgacaggactttctgttatccgtgcattcggacgagagaagaaagaggaagaacgttttgatgatgcgaatcggagcctgactaagacgacactttttaccaaccgcattatgacatttatgatgcctggtatgatgctgatcatgaatgtgcttacaataagcattgtatgggtaggtgcacacagaattgacagtggtgatatgcaggtaggtgcaatgacagcctttgtcacttatgcgatgatgattgttatgtcattcctgatgctgacaatgctttctattatgcttccgagagcagcggtagcagcagagcgtattgatgaagttattgtaacagagtcctctattcatgatgcagatcagacggaagcagttacagagcgtaatggtgtgattcgctttgaccatgtgaatttccgctatccgggagcggaagaagatgtattgcatgatattgattttatcgcagaaccaggcaagacgacggctattatcggaagcacaggatgcggtaaatctacgctggtgaatctgatcccgcggctctatgatgtgaccggcggtaagatcacgctggatggcaaagacatccgtaatattaagatgtcagatttgcgtgaggagattggatttgtgccgcagaaaggagtgttgttctctggtacgatcgcatctaacctgcggtttggcaaagaagaagcaacagatgaggagattgcgaaggcggccaagatcgcacaggcgaccgagttcattgagacgaaagatgacagatatgacagtgcgattgcgcaaggtggaagcaatgtgtctggtggacagaagcagcgtcttgcaatcgccagagcaattgcaaaggatccgaagatttttgtgtttgacgacagcttctcagcgctggatctgaagacagatgcggcacttcggaaagctcttggtgaaaatgtaaaggacagcactgtgatcattgtagcccagcggatcagtacgatcctgcatgcagaacagatactggttctggatgatggagaggtcgtaggcaagggtacacatgaagagctgttgaaaacatgtgaagtatatcagcagatagcgaagtctcagttgtctgcaagagagcttggacttgaagaaagtgaggtgtccggaaatgagtaa

SEQ ID NO: 2449 - DNA, 2583 bp, Dorea sp.
atgaatataaataaatttacgcagaaatcacttcaggcagttcaggactgcgagaagattgcaatggactatggtaatcaggaaatcgagcaggaacatttgttgtatgcattgcttacacaggatgatgggctgattccgaagatgatcgagaagatgggcctggacataggtgtggtaacgcagcgtgtggaacaggcaatcgccggccgcactaaggtgcaaggcggtaagcagtacgttggacaggatctgaataatgtcctggtgcacgcagaggatgaagcaaagcagatgggtgatgagtatgtatcagttgagcatctgttccttgcaatgcttcgttatccaagccgtgcaatgaaaggaatcttccgggagatgggtatcagtaaggaagggttcctccaggcactttctacagtgcgtggcaaccagcgggtaaccagcgataatccggaagccacctatgatacattgaacaaatatggtacagatctggtggaaagagccagagatcagaagatggatccggtcattggtcgtgatgcagagattcgtaatgtggttcgtatcctgtctcgtaagaccaagaataatccggtactgatcggtgagcctggtgtaggtaagactgcagtcgtagaaggtctggcacagcgtatcgtgaaaggcgacgtgccggaaggattgaaagataagacgatattctcattggatatgggggcactggtagccggtgccaaatatcgtggagaatttgaggaacgtctgaaagctgttctggaggaagtcaagaacagtgacggacacattatcctctttattgatgagttgcatacgatcgtaggtgcaggtaagacagatggtgccatggatgcgggcaatatgctgaagccgatgctagcgcgaggcgagttgcattgtattggagcaactacactggatgagtacagacagtacattgagaaagatgccgcactggaacgtcgttttcagccggtacttgtggatgagccaacggttgaggatgccatttctatcctgcgtggtctgaaagaacgttatgaagtattccacggagttaagattactgacagcgcgctggtagcagcggccacattatctaaccgttatatctctgaccggttccttcctgataaggcaattgacctggtggatgaggcatgtgccctgatcaagacagaacttgattccatgccgacagaactggatgagatgaatcgttgtatcatgcagatggagatcgaggaagctgcacttaagaaggaagaagatcgtctcagcaaggagcgtctggagcatttgcagcaggagctggctgaactccgggaagaatttgccggacagaaagctcagtgggataatgaaaagaaagctgtagagcgtattcataaggtgcgtgaagagattgaaaatgtcggtaaagagattcagaaagcacagcaggcatatgatctgaataaggcagcggagcttcagtatggtaagctgccgcaactcaaacagcagctggaagaactggaatcacagacaaaggatgaagatcgatccctggtacacgagtgtgtaacagatgaagagattgccagaattgtatccagatggaccggaattccagttgccaaactgaatgagagcgaacgtaataagacattgcatctggcagatgaactgcatcacagagttattggacaggatgaaggagtagaacttgtgacagaagcaatcattcgttccaaagcaggcattaaagacccaactaagccgatcggttctttcctgtttcttggacctactggtgtaggtaagacggaacttgccaaggcgcttgcagagagcctgtttgatgacgagtccaatatggtccgtatagatatgagtgagtacatggagaaacattctgtgtctcgtctgatcggagcgcctccgggatatgtgggatatgacgagggtggtcagcttacagaggctgttcgtagaaaaccatattcagttgttctgtttgatgaggtggaaaaagcacacccagatgtatttaatgtacttcttcaggtactggatgacggacgtattacggattctcagggacgtacggtagattttaagaatacgatactgatcatgacatcaaatattggttcctcttatctgttggaaggaattgatgagaacggtaatatcagtgaagcaagtaaggatgctgttatggcagatctgagagcacatttccgtccggagtttctgaatcgtctggatgagacaattatgtttaagccgttgacgaaggataatattcatggcattattgacttgttgatagctgatttgaacaaacgtttggaagagaaggagatttccatcaggctgacagatgcagcgaagaattacgtggtagaaggcggatatgatccgatgtatggtgcacgtccgctgaagagattcctgcagaaacatgtagagacactggctgctaagctgatgctgcagggtggcgtcggtgcagatcagaccattgtaattgatgtggagaatggcagtctgacggcaagaagcgaataa

SEQ ID NO: 2450 - DNA, 2616 bp, Dorea sp.
atggctgaaaagatcgtattgattgatggacacagtatattaaaccgtgcattctacggagttccggatctgactaacgcagatggacttcacacgaatgcagtatatgggttcctgaacattatgtttaagattctggatcaggagaaaccagagtatctgacggtggcatttgatgtacatgcaccgacatttcgtcatgagatgtttgaagaatataaaggcacgcgaaagccgatggcagaagaactccggcagcaggttcctgtaatcaaggaagtcctgcaggcaatgggagttaaaattgtagaaaaagccggtctggaagcagatgatattctcggaactatttccagaatgtctgagagacgggggctggaagtgtctgtgatcagtggtgacagagaccttttacagcttgcaacggagcatgtaaagattcgtattccaaagacgaaaaaaggacagacagagattgaagattattatgcggaagatgtcttgaatgcatatcaggtaactccaacggagtttatcgatctgaaagcgttaatgggagatacctcagataatataccgggattgccgggggtaggcgagaagactgcaacgaagatcattaccgagtatcattctatcgaaaatgcacatgagcatgcttccgaattgaaaccgccgcgtgcatcgaaggcaataattgaacattgggatctggcagttttgagcaagacactcgctacgatcaaattggatgcagagattgattatgagtttgcggatgcgaaactcggtaatttgtatacagacgaagcatatgtgtattttcagaagctgcagtttaaaaatctgctgggaagatttgagacatcggaactgtcgaataagattgaggacgcatttgagacgattacaaataaagagaaagctgaacagattttcacagatgcggcaaaagctgagcgtgttggcattgcactttgtaagaatacagaggatgtgcttccattatttgctgacctggcagagttcgcaggaattgcactatgctgttcagacgagcatgtgtattatataaagactggaaatgatatatcttcggcatggctgaaggagcagaccgtgcagcttgtggagaagaatgaatgttgcatattctttgacgtaaagaatgcaatgggagaacttggcagtcttccggtttcacattgttttgatggaacaatcgcagcatatttgctgaacccattgaaaagtgattataccggcgaggatgttgccagagaacggctgaatctgctgattgaggataagcttcctgatgacagcaaagcctgttacgaagcatataccggatggaaggctgcaccaattttgcaggaacagctgaaagagaacaatatgtggaaactgtttgtggatgtagagatgccgcttgttgagacattgtatgatatggaacagtgtggtgtccgtgtagaggctgatgagctgaaagcttatggtgagaagcttggcgtgcggatccatgaactggaacaggaaatatatgaagaggccggcgagatttttaatattaattcaccgaagcaattaggcgtgatcctgtttgaaaaaatgggattacagggcggaaggaagacaaagaccggatattcgacagcggcagatgtattggagaagcttgcaccagagtatccgattgtagcgaagattctggaataccgtcagatggcaaaactcaagtcgacttatgcggatggattggctggttttattcaggcagatggaaggatccatgggaagttccatcagactattacagcgacgggacgtctcagcagcgcagaacctaatctgcagaatattccggttcgtatggagcttggcaggctgattcgtaaagtgttcattccggaagatggttttgtgtttgtggatgcagattattcgcagattgagcttcgtattcttgcgcattgttccggagatgatatgttgatcaatgcttatcgtcaggctcaggatattcacagaattacggcttcgcaggttttccatgtaccgtttgacgaggtaacggatcttcagagaagaaatgccaaggcggttaattttggaatcgtgtatggcatcagttcttttgggctgagccaggatttaagtatcagcagaaaagaagcggcagaatacattgatcagtattttctgacctatccgggaatcaagacatttctggataatacggttgcgtctgccagggaacatggatacgtggagactttgtttggaagaagacgcccgatgccggagctgaagtcgtccaattatatgcagagatcatttggagaacgtgtggcgatgaatgcgccgattcagggaacagcagctgacattattaaagtggcgatgattggcgttagcagaaggctgaaagaaaaacagatgaaatccagacttgttcttcaggtacatgatgaactcctgattgagacttatattccggaactggaacaggtagaggagattttaaaggaagaaatggaacgtgcggcagaccttaaggtaccgcttctggttgatatgcataccggcaataactggtatgaagcaaaatag

SEQ ID NO: 2451 - DNA, 1422 bp, Unknown
  Description of Unknown: Intestinimonas sequence
atggcaacctacaatccagtcacccctgaaatcatcgaagagctgaagaagatctccggcgaccgcgtcgtcgtgggcgcggacgtcaaccccgactactcccgcgacgagatgcccatctacggcaccaagatgcccgacgtctccattgatgtgctgagcaccgaagaggtctccgccatcatgaaggtctgctatgacaacaacatccccgtgacctgccgcggcgccggcaccggcctggtgggcgcctgcacccccatcgccggcggtgtggtgctgtgcaccatgcgcatgaagcagatcctggaatatgataccgacaactttgtcgtccgggtccagcccggcgtgctgctcaacgacctggctgaggacgccctgaagcagggcctgctgtatccccccgatcccggtgagaagtttgccacgctgggcggcaacgtctccaccaacgccggcggcatgcgggccgtcaagtatggcgccacccgcgactatgtccgggccatgaccgtggtcctgcccaccggcgagatcgtcaagatgggcgccaccgtctccaagacctcctccggctactccctgctcaacctcatcatcggctccgagggcaccctcggcatcatcaccgagctgaccctcaagctcatccccgcccccaagcagaccgtcagcctcatctgccccttcgaggacctggccacctgcatctccaccgtgcccctgttcaagaaggcccacatggacccccaggctctggagttctttgagcgagagatcctcatctcctccgaggagtatctgggcaaggccgtgttcccccgcaacatcggcgggcaggacgtgggcgcctatctgctggtgaccttcgacgccaacacccaggacgccatcgacgccctggtggagcaggccgccgagctggtggtcgaggccggcgccatggacgtcctggtggccgacacccccgccaagatgaaggacgcctgggccgcccgctcctccttcctggagggcatcgaggagcagaccaagctgctggacgagtgcgacgtggtcgtccccgtctccaagatcgccgacttcgtgctctacatcaaggagatcgacaaggagttcgactttgaggtcaagatgttcggccacgccggcgacggcaacctgcacgtttacacctgctccgtggacatggagatggacgccttcgtcaagcaggtggaccagttcatgcgcaagctctacgccaagaccaccgagctgggcggccagatctccggcgagcacggcatcggcatgggcaaggtggagtacctggccgagtctgtcgggcccgtcaatatgcgcctcatggaggagatcaagaaggtcttcgatcccaagatgatcctcaaccccggaaaggtctgctacaccctctga

SEQ ID NO: 2452 - DNA, 1506 bp, Unknown
  Description of Unknown: Intestinimonas sequence
accatgccagagtatgcaaagaaagatttggaagaactcatcatcggcaagctgcgccggaacttcggccgtgacgtggacgaggccaccgccattcatatgttcaaggcctgcgccatggtgctgcgggacatcatgtcagcccggcagctcaagaccgaggacaaggtgcagcgcacccacgcccgccagatccactacctgtccctggagtttctgatgggccgctctctgatgaaaaacgcctacaacctgggcattctggaggagctgaagggggccatcgaggatttgggcttctccgcccccgacctctttgaaatcgagcccgacgctgggctgggcaacgggggcctgggccgcctggccgcctgctatctggactctatgaccaccctggagatcccagccaccggctataccatctgctatgagctgggcatctttaagcagaagatcatcgacggccagcaggtggagctggccgacaactggctgcctgtgggcgacgcctggctcatccccaaggtggatgagacggaaaaggtccactttggcggccgggtcaaggacgtctgggacgagaacggaggccaccgggtggcgtacgagggcggcaccgacgtattggccatcccccgggacatggagatcgccggttacggcaccgagcacaccaacgtcctgcggctgtgggacgccaagagccccgacccggtggatatgaagctcttctccaccggccagtatctgaaggcggtggagcagcaggccatggccgaggtcatcgccaaggtgctctaccccgaggacaaccactacgagggcaagtccctgcggctcaagcagcagtatttcttcgtctccgccaccgtccagtccatctgccgcaagcacaaggcggagtacggcaccctgcgcaatttccatgaaaagcacgtcattcagatcaacgacacccaccccaccctggtcatccctgagctcatgcgcatcctgctggaccaggagggctacggctgggacgaggcgtggcacatcgtcacccacaccgtggcctacaccaaccacaccattctctccgaggccctggagcgctggccccagcagctcatcgagaccctgctgccccgcatctggcagcttctgatcgagatcagcaatcgctatcaggcccagctcaacgaggcgtttcacggcgaccaggccaaggtgcgggacatggcggtgatctggggcggcgaggtccgtatggccaacctgtgtatctgcgcctgtttcgccgtcaatggggtgtccgcgcttcactcggagatcctgaaaaaggacgtcttccacgacgcctatacccagaacccaggcaagttcaagaacgttaccaacggcatcgaccaccggcgctggctgtccgagatcaaccccgcgctggacgcgctgatccgggaatgctgcggcggggacgactacctgctccgccccgacgccgttcagaagctggagaaatac

SEQ ID NO: 2453 - DNA, 1044 bp, Unknown
  Description of Unknown: Intestinimonas sequence
caggaggagcgcattcccaaggagatcatcgagaagatggccgagattggcttcaccgccctgaacgtccccgaggagtacggcgggcccggtctggacaccgtgtgcaaggtgctggtggtctccgagctggcccggcagtgcgccagcaccgcggaggtcatcgccgtgcataccctggtcaacgacatcttcctcaagcacggcaccgaggtgcagaagcagaagtacctcaccgccgccgtggagggtaagatcggcgccttcgccctcaccgaggcgggcgctggctccgacgccgccgcagccaagaccaaggccgtggtggacggggacgactacgtcatcaacggcagcaagtgcttcatctccaacatgggccccaccgagggcgactatgtggtggtcatcgccctcaccgagccggagaagggcgtcaagggcatgtccgccatcgtggtggaccggggcacccccggctttaccgtgggcaagcgggaggagaagatgggcatccggggcgcggatatctccgagctgatctttgaggactgccgggtcccccgcagcaacctggtgggcaaggagggcgaaggcttcaagatcgccatgatggcgctggacggcggccggatcggcatggccgcccaggcgctgggcatctgcgaggccgctatcgccgcctccgtcaagtacatgggcgagcgggtccagttcggcaagcccatcggaaagaaccagggcctgcagtggtatctggccgacatggccacccgcaccgaggccgccaaggccctcatcctggaggccgccgtcgccgccgacaacggccagccgctgtccaagctggccgccatgtgcaaatactacgcctctgagaacgccgtctgggtcaccaacaaggcccttcagatccacggcggctacggctacatgcgggactatcccatcgagcgcatgtaccgcgacgcacgcatcgtccccatctacgagggcacctccgaggtccagaagatggtcatcgcacgcgaggtcatgaagtaa

SEQ ID NO: 2454 - DNA, 1719 bp, Unknown
  Description of Unknown: Intestinimonas sequence
atgaagcagaagaaggtgctgtcgctgctgctggctgtggccatggcgttcagcctgaccgtaccggccgtggcggcagagggcgacgccgcaggcacggagagcggcaagatcgtgatcctgcacaccaacgacgtacactgcggcattgatcaggccaagaacgacgcaggggaggtgaccaacatcggctatgcgggcgtggccgcgtacaagaccgccatggaggcggcctacggcgcggagaacgtgacgctggtggatgccggcgacgccatccagggcggccccatcgggacgctgtccaagggcgcgtacatcgtggagattatgaaccaggtgggctacgatttggccattccgggcaaccacgagtttgactacggcatggacaacttcctgaccttggcgcgggagaaggcggagtatgcctatctgtgcgccaacttcaccgacctggaggggaaggcggtgctggacggctatcaggtgctgacctacggcgacgtgaaggtcggctacgtgggcatcgatacgccggagtccttcaccaagtccaccccgacctatttccaggacgccgcggggaactatatctacagcttcagccagggcaacgagggcagggacctgtatgacgtggtgcagaaggcggtagacgcggccaaggcagagggcgccgactacgtggtggcgctggggcacctgggcgtggacgagcagagctccccctggacctccaccgaggtgattgccaacaccaccggcatcgacgtgctgatcgacgggcactcccacagcacctttgccaagaccgagaagaaccaggccggggaggacgtgctggtggcccagacgggcaccaagctggccaacctgggcaaggtggtcatcgacaccaagacgggcgagatcaccagcgagctggtggcggccaaggactgcgccgctgaggacgaggccactggggccttcgtgaagggcatcaacgacgagtttgccggggtgctgaagaaggtcgtggccaagaccgacgtggacctgaccaccaaggacccggccaccgggaagcgcgcggtacgcagcgccgagaccaatctgggcgacctgtgcgcggacgcctaccgggtgatgctggacgccgacgtggcctttgtcaacggcgggggcgtgcgcgccgacatccccgcgggggagatcacctatgagcagatcatcaacgtgcatcccttcggcaacgaggcctgcgtggtggagaccacgggccaggacattctggacgcgctggagatgggcgcgcgtgtgacaccggaggagaacggcgggtccctgcaggtctccggcctgacctataccatcgacacctcgattccctcctcggtggtgctcaacgacgagaaggagttcgtgaaggtggacggcgagcgccgggtaaaggacgtgaaggtgaacggcgaggccattgaccccgccaagacctacacgctggcctcccacaactatatgctgaagtccggcggcgacggcttcgttatgttcaaggacgatgccctgctgaaggactgcgtgatgatcgacaaccaggtgctgatcaactacattgtggacgagctgggcggcgtggtgagcgccgactactccgatcccaagggccagggccgcatcacggtggtgggcgccccggctgaggagcccgaggctcccgccgactgggcggat

SEQ ID NO: 2455 - DNA, 1872 bp, Unknown
  Description of Unknown: Intestinimonas sequence
gccggctgggaggtgacgcggccgatgttctttaagctggcgcggagaaacgtcacccgcagtctcaaggactactcggtgtactttctcaccctcaccctgggggtgagcctcttctatgtgttcaattccctggagggacagtgggcgatgcagatgctggccaaaagcgcccactatatggtggaatccatcctcatcttcatgaacatcttttccgccttcgtctcggtggtgctggcctgcctggtgctttacgccaacacctttttgatgaagcgccgcaagcgggagctgggcacctacttcttgctgggtctgcccgcaggcagggtctccctgctgctggtgctggagaccctgctcatcggtctgatggccctggccaccggactggtgctgggggtcctgctggcccagggcctggggctgctcaccatcgccatgttctccgcctaccctgccggggagcagttcgctctggtcctctccgtcaaggccatcggcaagacggtgctctacttcggcgtcatcttcctggtggtcatgattctgaccggggtgtcggtctcccgggccaagctcatcgacctgatgcagggagcccggaaaaacgaggagatgaaggagcggcccctgtggaccagcgtcctcaccttcctggccggggtggctctgctggtcgtcgcctacgccatgctcctcatccggggcatgctgtatatcgacccgctgttcttcctcatgctggccctgggtactctggggaccctgctgtttttccggtccctgtccggcttcctgctgcgggtggtgaaggggcacaagaagctttattacaggggcctcaacatgtttgtgctgcggcaattcaactcccgcatccacaccacctacctgtccatgacggtgatctgcctgctcctgctgctggccatcggcgtcaccgcctgctgtgtgggcctcaacgacaccatcgagcagaatacctcctccgccgccccctacgacgtcaccatccagaattacagtggggacaccaccgtggcggacctccccgcccggttggcagagtccggctttgaccccgctctgctgggggagcagcacgactttctcttctactacaacgaccccgccgtcaccggcatccccgcggacgacgcctatgccgtggtgctgctctccgactacaacgcgctgatggccctccagggcgggcaggccctgaccggggacggtctgccccttgtgaccgatcaggccatcgtgaccggctacagcggtatgaaccgctatcttgtggcccccgacagttgggcggaggcgctccaggtccggcggcaggtcttctgcgccaactaccggggcgacaagcagaccgccgaggacgcccttgccgccgcctgcagctcccccgccttttccgacgggctcacgctgtctctggacactcgcatcggaatctacacggagaatatgggcagcaagatcctggtgctgttcatgggactctatctgggcatggtctttctcctcaccgccgcggcggtgctggccctccagcagctcagccaggcggcggacaacgtgcctcgctatcagattctctcccgcctgggcgtcccggagcggatgcgggaccgctcggtactcacccaggtagccctgtccttcttcctcccgctggccctggcggtggtccactccatcgtgggcatgacggcggccaacgccgtgatctccgccgtggggcgggtggattcggtgcgcagcagcctggtcaccgccggcttcttggtgctcatctacggggcctacttcctggccacctgcttcggcgcccgccgcatcgtcaaaggaaacgggtag

SEQ ID NO: 2456 - DNA, 1371 bp, Unknown
  Description of Unknown: Intestinimonas sequence
atgttcaaaaaatttaccaatggctgcgtgcgcgtagtcaaccggtggctgccggacccgttcctgttcgccatcatcctgagcatcgttgtgtatgtcgccgcaatgctcggtacacagcagggccctgtcgccatgatcaaggcgtggggcaacaccagcggtttctggaatctgctggccttctcgatgcagatggccttggttctggtgctgggctccgccatggcctccgcgaaggtctttaagcggttcttgggcgctatcgcctctaccgccaagaacaagaagagcgccattctcatcaccacctttgtgtccgtcatctgctgctggctgaactggggcttcggcctcatcgccggcgccctgctggccaaggaagtggcccgccgtgtccgcgatgtggactaccgtctgctcatcgcctcggcctattccggctttgtcatctggcacgccggtctgtcgggctctatcccgctgaccatctcgggtggctacaccatcggcgaggccacctaccaggccggcaccaatctgaccatcttccatcccatgaacctgctcatgtgcgcggttatcctgattgtgatgcccttcgtcaactacgctatgcatcccgatacggagcacaccattactgtggaccccgctctgctggtggacgaggctgagaaggagtattccgtcagcaccccggctgaaaagatggagcacagcaaaattctgtggatcatcaccattgtggccggctttgcttacatcgtcttctatttcatcgacgtggtccagaagagcggccctgccgggattcccaacagcctgaacctgaacatcgtcaactttatcttcctgtttgtgggcgtgctgctccacggcgatctgcgcaagtacgtggacgccatcggtgaggctgcctccggcgcggccggcatccttctccagttccccttctatgccggcatcatgggcatgatggtcgccgccaacgccaacggcgtatccctggcctccatcatttccgacttcttcgtcagcatctccaacaacgtcaccttccccctgttcaccttcctgtccgccggcatcgtgaacttctttgtcccctccggcggcggtcagtgggccgtgcagggccccatcgtgatgcctgctgctagtaagatgggcatcgaggctggccgtgcctgcatggccatcgcctggggcgatcagtggaccaatatgattcagcctttctgggccctgcccgctctgggcgtagccggtctgtccgccaaggacatcatgggctatctggtcatcgtgctgatctttaccggcctggtggcctgcggcggcttcctcctgtgggccgcgctgttctaa

SEQ ID NO: 2457 - DNA, 1536 bp, Unknown
  Description of Unknown: Intestinimonas sequence
atgaacgaggaggcattggatcttaccgtaggtgttgacgggatcaaagatggctaccgggcaattcttgacaccattttttgcagcattcttgtgtttgacggtaatggacaactgatccactgcaactgcgccgcccggaattttttccatggactgggcattgatccggagcgcgcgtattttacccgttttgaggccttttccgagccgatggcagagcgggtggacctcatcagcgggaagggccgctacatcatcgagctggaggggaggcaggtggtctgcaacgtccacccgtgggtgatcgacggggtccggcggggcaccatttttatcctgcacgaatccatgcactccaactgcatcatgcaggagctggacgtgaccaacagcctgcttcaggagatcaacatcttcgtagagtcctctcacgacggcattttggtcaccgacagccaaggcgtcgttatccgggtcaacgccgcttttgagcgggctttttcggtcctccggcgggaggtcattggccggaacgtcacggagctcatcgccgagggcctgtacctggattcggcggccctcaaggtcctggagaccagggagaccgccaccgtggtcctggagcagaaggggaaacggctcattgccaccggtacccccgccttcgacatctgcggcagcttcacctccgtggtggtaaacattcgggacatcaccgagctaaacgacctgcaaagccgtctggagcaccagcgcatggtggcggagggctacatacgggagctgaccttcatccagagccagaatgcccccggtgcggatttcgtggtccacagcaaggaaatgcagcatatcatggacaccatcaagaccatctcccaggtagattccacgctgctcatcaccggagagtcgggcaccggcaaggaagtcattgtcaaccaggtccaccgctccagcaaccgccgggacaagcccatcatcaagatcaactgcggggccatccccgcgtccctgtttgaatcagagctgttcgggtatgaggacggggcctttaccggcgcccgccgccgggggaaggccggcttttttgagctggccaacgagggcaccctgttcctggacgagatcggagagctggatctggacctgcaggtcaagctgctgcgggtcatccaggagggagaggtcacccggatcggcggcaccaagacgcttcatgtggacgtgcgcatcattgcagccaccaaccgggacctctggcagcaggtccaggagggcaaattccggcaggacctctattaccggctcaacgtgatcaacatcgaggtgccgcccctgcgggagcggcgggacgatgtcatcccactggccgtccactttatcgagaagtacaaccaaaagtacagcaagcacaaggagctgtccatggaactgggcaagatcctgcgctccctggactggctgggcaatatccgcgagctggaaaacctgatcgaaaacatggtggtgctggtccagcgggacgtgctc

SEQ ID NO: 2458 - DNA, 1326 bp, Unknown
  Description of Unknown: Intestinimonas sequence
ggcgcgctggagctgggtatcctgttctctgattttgacgccgcctacgccaccgccaagaaggacggctcctacaccctgacgttcgactggcgcgagcccctgcccgtgggcgtccgctggtttgaggacgtgaagaacaccgacgtacggaaggaaatcgccaagatccaggcccccgtgctggccatcaacggcgatcaggataccacggtcacccctgacaacgccgtggccatcgctcaggccgcccagaacggccggagctggctggtagacggcgccgacctcacctataatatcttcaccggcgactttaccgccatcacccagaccatcaacgtgggcatcggcttcctggaggagaccttcaacggcgcgctggagcccgcctatgccgcctccgtcagcaagtacggcaacgtcaccaccaccctgcccgtagatctctttgacggggccgggtacgccgtgggcgacattctgaagatcaccgtgggcgatcagaccatcgaggccccctacggcaccgcctatgccaacgtggacaacggcagcgtcatcgtcctgcccgacgcctccaccggcaccgtggccatcgccatcaacatgggcaacttcgcctccacatacaacgtcaccgccgacacccccatcgtcttcgccatgggggagaaggagggctatctggaggagtacgagatccgcaacatcgactctctgcgcaccaatgaccgggccgactacgcctccgacgaggtgttcgccaacttccgccccgtggtcatgggcgacatcgccgagggcgtgctgttccgctcctccagccccgtgaaccccgagctgggccgcaatactcacgccgacgccctggtggagaaggcgggcgtcaagaccgccatcaacctggccgacagccaggaggaactggcggcctatgagggctatgccgactcctactacgccacgctgaacgtggtggcgctggacatgggcgtggacttcgccgccgaggacttcaacgccaagctgaagaccggcctggagttcctcatcgccaacgagggcccctatgtcatccactgcaacgagggcaaggaccgcgccggcttcaccgccgcgctgctggaggccgtgtgcggcgccagcgtgggcgagatcgtggaggactacatgcgctcctacgagaactactaccacgtggagtaccactctgaccgctggttcagcattgccaacagcaatattatcaagaccctgtgcaccatcaccggcaccgagacccaggccgacctggagaaggccgacctgaaggccgccgctgag

SEQ ID NO: 2459 - DNA, 1359 bp, Unknown
  Description of Unknown: Intestinimonas sequence
atggcattcgaaggtttgaccgaaaagctctcctccgcctttaagaagctgcgcggcaagggccgcctgtccgagtccgacgtcaaggaggccatgcgtgagatccgtctggccctgctggaagccgacgtcagctacaaggtggtcaaggagttcatcaaaaaagtcacggagcgggccgtaggcgccgacgtgctggagagcctcacccccgctcagatgatcgtcaagatcgtcaacgaagagctcaccgccctgatgggcggccagagcaccaagctgaacctatcccccaagccgcccaccgtagtcatgctggtgggtctcaacggcgcgggcaaaaccaccaacggagccaaactggcggggtatatgaagaggcagaacggcaagcgccctctgctggccgcctgcgataccttccgccccgctgccatccaccagttggaggtcgtgggcgggcagttggacattcccgtgtttcagatggggcagatcgacccggtggatattgccaaggccgccattgagcatgcaaagaagcacggcaacgacattgtgttcgtggataccgccggccggctccatgtggacgaggagctgatggaacagctcaaggtgatgaaggccgccattgaccccgacgagatcctgctcatcgtggacgccatgatcggtcaggacgccgtcaacgccgcccaggcctttgacgaagccctggacatcaccggcgtcatgctcaccaagctggacggcgacgcccggggcggcgcggccctctccatcaaggccgtcaccggcaagcccatcaaattcgtgggcgtgggtgaaaagctggaccaaatcgaggtcttccacccggaccgtatggcctcccgcatcctgggtatgggcgacgtgctctccctcatcgaaaaggcggagcagaacttcgacgcgaagaaggctgccgagctccaggagaagatgaagaaaaaccgtctcaccctgacggattactacgaacagcttatccagctcaaaagcatgggctcgctgtccgatatcgccgggatgctccctggcgtcaacgccaaggcgctggagggcgccaccgtggatgagcgtctgctgtcccagactgaggccatcatcctctccatgacccccgcagagcgggagaacccctccctgctcaactccagccgcaaaaagcgcatcgccgccggcagcggcacccaggttgtggacgtcaaccgactgctcaagcaatttgagatgatgcagcagatgacccgccagatggcaggcggcaagctggccaaaaagatgggccgcttcggcggcatgggtaaaaggaagggctttcccttcggatga

SEQ ID NO: 2460 - DNA, 1758 bp, Unknown
  Description of Unknown: Intestinimonas sequence
tataccgcctccatgtacgccatcgccgaggagtcccgctggtacgacgtggccgaggagaacggctttatcgtggtctttgcccagggcctggtccgaccggctgatatgatgggcaacatccccaccgccatgtggcttgcgggtcccttttccgctctggccggcgcgggtgtggacaaagatacggatctgaagttccttgacaccctgctggataagctggaggaggaatacagcattgacaccagccgcgtctacgccaccggccattccaacggcagcctgatgacctgggccatgggctccaagtttgccgaccgttttgccgccatcgcccccgtgggctatatgtcggcgccgatggacgggattgcgtccggtaccatgctgcccacctggtccttcctgggcgagtacgactccgccggggatcccaccctggtggaaggcggcgcgaccgtcaaggcgcttcagggatggaaccagcagaacggcaccaacgaagctcagatgagcaccagcaagcagtacgacgacgcttttgtcacccgcacctttgccaataacgacaacgtgccgctggtcaagtttaccgaggtaaagaatacgccgcatgtctaccttcaggaagagagcgaggccatctggaacgacttcttctccaagtacagccgcggcgagaacggcacactctattaccaggccagtgaggagagcgaaaagactgaggtcacaatgagcgaatacgtcgccgacgacggctggtacaaggctgacggcgacgcagaccagaccagcccggacgctgcggcgattcagaagtccatcaccgcgattgcggaaaccgatggctttcagctcgtaaacgtcccgtatgagtgcacgaccaaccacaagaacggcgaagcggtgggcagccatcccttcagctccatgtactgctccgtgggcgacatcgaccaactggccaagcagtatggctttggcgagatggagttcttcatgtcgggcaaggccaacgtatatggcttgtctgacaaggggaccaacgtgccggtcatcaagactgcggacgtggattataccacccgcctgctgatccattaccctgaagatgcggaaaagttttccgggaatatctatgtggatatcctgaatgcctccgccggctatgacctggaggatatcttccgccgcagctacgagcacttcatggccaacggcgacatctacatcggcatcacatccaagaccaccaccgcccaggcgctgaaggacttcgatcctgagcggtacgccgctattgactggctggtggacaacaacgacccggagtccgccgagaacggcctgttttgggatatgctctctcaactgggcaccgtactgaaggaacggcccgaggacatctttggcaccgagttgggccaaaagataaaggacaacggccgtacctacctggtggggcagagccagtccggcttctatctccagacctatttgatggcgttctatccctacatcaacaatgtcctggatggaaaagacatctatgacggctatttcaacgcagtcggctccactccgacgaccctgtccactggtgtaaaaatggaaaatgtgggctggccgaagaccgaggagccctacctggtgctcatgggtgagggcgaagccaaaatgcgtctgtcgtccaactattaccccctgcaggaggacaagagcgaggaggactggaagttccgcctctacgaa

SEQ ID NO: 2461 - DNA, 1752 bp, Unknown
  Description of Unknown: Intestinimonas sequence
atgtgcggtatcgtcggattcattggaacggaagaggcggcccccatcctgctggacggcctggcccggctggaataccggggctatgactcggccggattggccgtgtacgaccaggtggaggggctgaaggtggtcaaggccaagggccggctgcaggtcctgtcggacatcgtggagggcggaaagaacatccatgggaccgtgggcctggggcacacccgctgggccacgcacggggagccgtcggacgtcaactctcaccctcaggtcagcatgtcggggcgtattgcggtggtccacaacgggatcattgagaactatgttcagatcaaggaatttctggagtccaaggacgttaaatttgtctcacagaccgacaccgaggtggtggcccagcttctggaatactactaccggggcgacatcatggaggcccttaccaaggtgctccaccgcatcgagggggcgtatgccctcggcatcatctgcgccgactgccccgaccggctcatcgccgcccgcaaggacagtccgttgatcctaggctatggcgagggctgccatttcctggccagcgatgtgaccgccgttatcaaatacacccgggaggtatgctatctggaggatggggaaatcgccgtcctcacggcggacggcatcaccgtctacaatcacccctacctccaaccggtggagaaggaaaagcaccatgtggactgggagatctccgccgccgaaaaaggcgggtacgagcactttatggccaaggagatcatggagcagcccaaggccttccgagacacggtatttccccgcatccaggatggccgggtggtgctggatgacctgaacatcgacggagagtacctgaaaaatgccgacaagatttacatcatcgcctgcggctcctcctaccatgtgggtatggtggccaaatacgtcctggaaaaactcctgcgcaaaccggtggaggtgacgctggcctccgaattccgctactgcgatccgctggtgagtgagcggacgctgtgcatcgtcatcagccagtccggtgagaccatcgacaccctggccgccatgcgcgaggccaagcggctgggcgcgcgcattctgtccatcgtcaatgtggtgggctcatccatcgcccgtgagtccgacgacgtactctacacctgggctgggccggagatcgctgtggcgactaccaaggcctactccacccagcttgcggtcatctacctgatcgctctgcggtttgccgagctgctgggcaccatcgggaaagaggaatacgaggatatggtggccgagctgctcaccatccccaccaagatggaacgtatcctggaaaaccgaaaggccatccagtactatgcctccatctacttcaaccacgagtccatcttcttcatcggccggaacatcgactacgccatcggtctggagggctcgctcaagctgaaggagatctcctatatccactccgaggcgtatgccgccggcgaacttaagcacggtaccatctccctcatcgaaaacggcaccctggtggtggcgctggcgagctgtgtccagttgtttgacaagctgatgagcaacgtggtggaggtcaaatcccggggtgccgacgtggtgggcctgacggtggagtccagggggagcgcgctgaaaaagacggtggaccacaccattctggtgccggatacccatcccatgctgctgcccagcctggatgtgatccccatgcag

SEQ ID NO: 2462 - DNA, 1425 bp, Unknown
  Description of Unknown: Intestinimonas sequence
atgctggaggaatggtctgtgaagaggcgaatttttgtctgccatacgctcaccgtactggcggcgctggtgacgctgctggtggtcagcggcggtgtcatggggtgggtcacgcaccgttatcaggagtggtcccgctcggccatagacgaccgggcggagcaggtacaggcccttctgagcggcagcagcggcacggattgggggcggctggacgctcaactgcgcgagtttggctaccatctacgggtcggccaaaacggtcgggagctgtactcctccctggaccccttccaggaggacgcctaccagcgcttttccgccgacgcggtctggccccccaacggcacacacacgatccagaacgacggaatcctgatgatcggcacgcagaacggcccctatacaatcgtcgccatgtcccgcccccatattcccgaggtcttcggccgccagcgcccccagtccgaagccgtcatgctgtccctgatcaccagcggtctgaccgccatcgtcctgatcgttctgctcagtctgctctttaccaaccaccaggtcaaacagctcatgcgccccgtcaacgccctggccgacgccgcccagcgggtggagcggggcgacctgtcccgtccggtggactaccacggcaaggatgaatttgcctccgtctgcgccgcctttgaccacatgcagcgccatctgctggccgaacgggagaaaaatgccgcctacgagcaggcccggaccgatctggtggccggcatctcccatgatttgcgcacgccgctgacgtcggtgaagggctacatcaagggtctgcgggacggggtagccaacacgccggagaagcagcggcagtacctggacgtggcctaccgcaaggcctgcgatatggacatcctgctccagcggctgttttacttttccaaaatggagaccggaaatctccccctctttccggagcgggccgacctgggcagcttcgtgcgcaggtttgccgaggatatccagggcgagctggaggccaagggcggacatattctggtgcagggcgctcccaccccccaccccgtccgcatcgacaccgagcagatctaccgggtgctcaccaatctgacggacaacgcgcagcgctacgcggggaccactccactggagctcaccctgaccatatggcgggagcgggacaccgaacgtctgcgctttgccgacaacggcgccggggtgccggaggagcagctttcccacctctttgagcagttctggcggggagatcaggcacggggcagccggggcggcgagggcagcggcctggggctgtatatcgtcaagtatatcgtggaggcgcacggtgggaccgtcgccgcacggaacgaccatgggctggtgttcgaaatcgccctgccctgtgaagaggaggtttga

SEQ ID NO: 2463 - DNA, 1815 bp, Unknown
  Description of Unknown: Intestinimonas sequence
ctgacacgaaagccaaaactggtggtttcgattgcggtcctgcttctgatccccagcatcctgggggccgttgccacccgcatcaactacgatatcctgtcctatctgcccgacgatctggattccgccaagggggaggctctgctggaggagcccttccacatggcggccaccaccatgctgatcgtggaggatatgccccccgagtacaccaaccagctccagaaagaggtggagcaggtccccggcgtcagcaacgccatctggctgtccagcctggtgggcatccagatcccccaggagatgatccccgcggacatccgagacatcttcttctccggcgacgccaccatgatgatcgtccagtacgaccagcccggcgcgtcggaggccacgatgaaatccatcgaacaggtccgctccctgtgcaacaaaaactgctttctggccggcttctccgtctttatcaaagacaccaaggacctgatttcccaggagatgccgctgtacgtactgatggccgtggccctgtccatgatcgccatgtgcgtgatgatggagtcttgggcactgccggtggccctgatgtgcagcatcggcctggccgtgatctataacttcggcaccaacttcttcaagggtgagatctctttcatcacccaggccatcgcggcggtgctgcaactgggcgtcaccatggactactccatcttcctctaccaccgctatgtggaggaggtcccccgccacgcggacaagcgggacgccatggccacctccatcgtggccgccttcaagtccctgtccggcagctccctgaccaccatcgcgggctttttggccctgtgcttcatgcggttgaccctgggcatggacctgggcatcgtcatggccaagggcgtggtgctgggcgtggccaccgtggtactggtgctgccctccatcctgctgcagatggacggcgccatccggaaataccgccatccggctctcaagcccaacttcgaaaagctaaacgccttcgtggtccggcaccggcatttcttcgtggggctcttcctggttctgttcctccccgccgtctattccaacaaccacacgcaggtctactacaagctggaccagtccctgccccaggatatgccctccatcgtggccaccgacaagctcaaggatgagttcaacatggcctcgtcccacttcatcgtgatgcgtgacgacctgagccgggccaaaatgaaggagctggaggagaccatcgacgacatccccggcatcaccagcgtggtggcctacgacaagctcatcagcggggccatcccagacttcttcatccccgacgacgtgaaggagctgtgcaaggcggagggctatcagatgctgatggtcaactccgaatacgtcaccgcctcgaacgaggtctctcagcagctcgccgagctgaccgagctgctccacacctacgaccccggcgcctatatcaccggcgaggccgccatgaccgacgacctcatcaccgtgtccgactccgacttccggatcaccagctatctgtccatcctcgccattctcatcatcgtggcctttaccttccgctccctcaccgttcccatcctgctggtggccaccatcgagctggccatcttcatcaatcagggcatcccctacttcaccggaacggtgatcgccttcgtggcccccacggtcatcggctgcgtccagctcggcgccacggtggactacgccatcctgatgaccacacggttccaggaggagctgcaaaaggggagggaccgcaaggaggccatccagatc

SEQ ID NO: 2464 - DNA, 1452 bp, Unknown
  Description of Unknown: Intestinimonas sequence
attgacgaggggctctccgccgccaccaccaagaaccgggaaaactttcaccgcatggtggaggacggccaggccggggcctttgacctcatcatcaccaaggagatcacccgcttcgcccggaacaccctggactccatccagtacacccgccgactgttgaacgccggcgtgggggtctttttccaaaacgacaacatcaacaccctggacgaggattccgagctccggctgaccatcatgtcgggtatcgcccaggacgagctgcgcaagctgtccagccgggtgaagtttggtcatcagcaggccatcaaaaaccgggtggtgctgggcaacagccgcatcttcggctaccgcaaggacaagggccggttggtcgtcgacccggaggaggcccccatggtgcgggagctgttccagctctatgccaccggacagtacagcctgaaacagttggagaaccgcttctggacgcagggctaccggaaccacaacggcaaaaagctgtctcacaccaccatgtccggtatcctctccaatccgaagtacaagggctactatgcgggcaacaaggtcaaggtcattgacctgtttaccaaaaagcagaaatttcttcctccggaggagtgggtgctgttcaaggatgaatcgggcactattgtgcccgccctggtggaggaggccctctgggagcaggccaaccaggtgctgaaacggcgtagcgcggatgtccggcaccgccagggcatctgcaaccacgccaacctgctcaccggcaagctctactgcgcccactgcggctccgcctactaccgccgggactctgtcgaccggaccggccgcaaaaacagcaagtgggtgtgcagcggtaagatcaaaaacggcgcggcctcctgcccctcctttcccatctacgaggaggaactcaagccccttctcttccaggtgttccgtcaggccgacgccgacgccggggcgctggtggaggagtatatcgagctgtaccgttctctggagcaggagggcgggctgacccggcacatggaggcgctggagcaggccattgggacggcggaaaaaaagcggcagaagctgctgaccttcaacgctctgggcgagctgtccgaccaggactttctctctatgaaccgccagtgcgcccaggagatcgaagccgcccgggcggagctggaggagctgtccgcccagcgcggctccgcctccgacttcaaatcccacatcgaatctgtacgccggacgctccaggccgcccggcaggaggcatccagcggtctgatcggtaaggaattcgtggaccagtatatccagcgcatcgtggccacaccggaggccgacggttccatgcgcctccagatccaactctttaccggcgagaccaccgaccgttatctgcggaatctgcgctccagtgccgcgcgggatgtgggctgg

SEQ ID NO: 2465 - DNA, 1602 bp, Unknown
  Description of Unknown: Intestinimonas sequence
atgggagacagagtttgtgagccgatcaccagacgggaagaagtctaccaaagtgcgctggacaccatctattgcgccattattattctggatcaggctggaaagatcctttatgtcaatgagtctgcacggaaaatggtggaggggtcctctgtggtgttcgaggagcttttggagtgccttggacaggaggtagacctggtgcgcggctcggggcgctaccaaatagacgtgggtccggccaggatcgtgtgcagggtgaaccccagatatctgtccggagagcgccatggcagcaccatcgtgctccaccaatccaagcattccgagtgtgtcatgcaggaaatggacgtagtgagcagtatcttcgaggagctcaacgtctgtctggagtcctcccacgacgggatcatggtatcggacggcatggggaacgtgatccggctcaacgccgcgctggagaagctgataggagtcaagcgccgggatatcctgggccggaacgtggccgatctggtgcaggagggcgtgtatgagtcctctgccatcctccaggtcattgagaccgggaagacggctaccgtggtcatcgaccacaacggcaggcaattgctgatcaccggctcgccgggctataatgccaacagcgccatgacggctgtggtggccaacatccgggacatgtccgagctgaacgacctgcgccaaaagctggagcagcagcagatgattgctgagaaatacagcaaggagctggcccatatcgcccggcagcagagcgcgcagaccagctttgtggcctgcagccgggagatgaagaccatcctggccaccatccattccatctctgaggtggactccaccgtcctcatctcgggagagtcgggcaccggcaaggagatggtcgtcaatgagatctatgcctccagcatgcgcagctaccgccccatcatcaaggtaaactgcggtgccatcccgcccgccctgtttgagtcggagctgtttggctatgaggacggcgcctttaccggggcgcgccgcaagggcaagcccggattttttgaactggcccacatgggcacgctgtttctggacgaggtgggggagctcccgctggagatgcaggtcaagctgctgcgggtgctgcaggagggagagatcatccgcatcggcggatcaaagcccatcagtgtggacgtgcggatcatcgcggccaccaaccgggatctgtgggagatgaccgaagagggcaccttccggcaggatctgtactaccggctgaacgtcatcaacatcgaggtgccccctctgcgccagcggcgggacgacatcattccgctggtcatgcatatgctggagcgcttcaaccagaaatacggcaagcacaaggagatccccatcgagctgggcaaggtgctgcgggagctgccctggcgggggaatgtgcgggagctggaaaacctgattgaaaacctggtggtcctctgcccggaggacgtgctgacgccggagcatttgccggtgcggtaccaacgcggccagaacccggcgtcccaggtggagattcgggggattctgcccatgaaggatatggtgcgccgg

SEQ ID NO: 2466 - DNA, 1248 bp, Unknown
  Description of Unknown: Intestinimonas sequence
atgatcgacatggtgcagggctacgccgcggtcaacgctggtgaggccgaccccaccaccctgggcgtctccgctcccgacgagagcaccttcgtggtcaacctgacctacgactgcccctacttcctggagatctgcgccttccccgccgccttccccgtccgtcaggacatcattgaggcctatggcgatacctggaccaccgacgacaactccagccactatatctccaacggcccctggaagctggccgagtgggttcatgattcctacatcaagatggtgcccaacgagtaccactatgatgccgccaacctgggccccaactctctgaccttccagctcatggaggatcagaactccatgctggccgcctaccgttccggcgacctgcagttcatcgaggatatgcccgtggatgagatcgctggactgctggcttccggcgagctgaacatcgtggattatattggcacctactatgtctgctatcagacccaggccgcgccctttgacaacgccctggtccgccaggcctttactctggccatcgactccaagtatattgtggagcaggtgacccagaccggccaggtgcccgccaccggctttgtgcccgccggcatctatgacgccgatgccaacggcgacgacttccgcaccgtgggcggcgactactgggacgcccctgtggacgacgccacctaccaggccaactgtgagaaggcccgccagttgctggctgaggccggctatcccaacggcgagggcttccccaccgtgacctacctgtataacacctccgacgcccacaaggccgtgggcgaggccctgcagcagatgtggcaggaggagctgggcgtcaccgtgcagctccagaaccaggagtggaacgccttcctggagacccgtaagaagggcgagtaccagatcgcccgcaacggctggatcgccgactacaacgatccctgctccttcctggatatgtggtacaccggcggcggcaacaacgacgcccagtactccaaccccgagtacgacgccatgatcgacgcggccaaggccacgtctgatcccgccgagcgcatgagctacttccacaaggccgaggacatcatcatcggtcaggattgggcgctgggccccatctacttctacacccagaagtacatgatggccgacgacatcagcggcgccttctacacccccctgggctacttcatctacggctactgcaccaagggctga

SEQ ID NO: 2467 - DNA, 1626 bp, Unknown
  Description of Unknown: Intestinimonas sequence
gtggcgaaatcgaacttagtcattgtagaatctccggccaaggccaagaccatcggcaaataccttggaccggattatcaggtcaaggcgtccatgggccacgtccgggacctgcccaaaagcaagattggcgtggatgtggagcacggcttcgtgccggactaccagcccatcaaagggaaggaggaggtcatctccgacctgaaaaaggcggccaagcagagcgacaaggtctttctggccaccgacccggaccgggagggagaggccatttcctggcacctcaaggagcttttggagctgcccgacgaccgcacttaccgggtcaccttcaatgagatcaccaaaaaagtggtcaacgagtccatcgccgcccctcgggccatcgaccaggacctggtggacgcccagcaggcccgccgcatcctggaccgcatcgtgggctaccagctctcgccgctgctgtggaaaaaaatccgccggggcctgtccgccggacgggtccagtcggtggccacccgtctggtgtgcgagcgggaggaggagatccgggcctttcagccccaggaatactggtccctggacgccgatctcagccgcatctcccccaatctgggggccttcaccgccgccttccacggcgcggagaagaagcaggagctccgcagcgagcaggaggtccggaccgtcagcgacgccgtgaaggcggccccctttaccgtgaagagcgtcaagcgccaggacaagacccgaaatcccgcgccgcccttcatcacctccaccctccagcaggaggccagccgcaagctgggcatgacgccccggcggaccatggcggtggcccagcagctctacgagggcgtggacatccagggcgagggcactgtgggcctcatcacctatatgcgtaccgactccctgcgcctgtctgaggaggccctggcggccgcccgggagctgatcatcagccgctacggcaaggactattatccagacaagacccggcactacaaaaccaaatccggggcccaggacgcccacgaagccatccggccctccgacgtgcgcctgacccctgaggacatcaagaaggatctgaccagcgaacagtaccggctctacaagctgatttggagccggtttttggcctgtcagatggcctccgccgtctatgacagcgtggccatcgaagtggagtccgcgggctaccgcttccgggccaatcactcctccctgaagttttccggcttcaccgccgtgtatgtggagggcaaggacgaggacgaggagaaggtccagtcccccctgcccgacctgaaggagggggaggcgctggtgctgaaggagctcaagcccgagcagcactttacccagccccccgcccggtacaccgaggctaccctgatcaaggcgctggaggagaagggcatcggccgcccgtccacttacgcccccaccatctccaccattctggaccgggagtatgtggtgaaggagggcaaatacctgcgcaccaccccgctgggggatgtggtcaccggcttgatgaaagacaaattccccgacatcgtggacaccgccttcaccgcccagatggaagagcagctcgaccaggtggaggagggc

SEQ ID NO: 2468 - DNA, 1335 bp, Unknown
  Description of Unknown: Intestinimonas sequence
ctctcccgcatgagccatgagatccgcacccccatgaacgccatcatcggcatgagcgccatcgcggcccagtcggtggggcgcgacgagctggtggccgactgcatcgccaagatcggcatttcctcccgcttcctgctctctctcatcaacgacattctggacatgagccggatcgaaagcggcaagatgctgctgaagagcgaacccatccccaccgaggagtttctcaacgggatcaactccatctgctattcccaggcggtggccaagggtgtggactatgagtgcatcctcgacccggtgctgaacgattgctacattggcgacgccatgaagctccagcaggtgctcatcaatatcctgagcaacgccgtcaaattcacccaggagggtggtaaggtcaccttttccgtctcccaacaccggaggaccaagaacggcgccctgctgcgctttatcgtcaacgacaccggccggggcatcagcgacgacttcctgccccatatcttcgagcccttctcccaggagtccacaggcaccaccgccctgtacggcggcaccgggctgggcctggccatctccaaaagcattgtggatatgatgggcgggaagatcaccgtgcgctccatcaagggcatcggcacggagtttaccgtagatgtcaagctgggcgtcacagaggaggaccggctccgccaccgccccaaaaagcaggactacaacttctcccacctgaaaaccctggtggtggacgacgacgtggccgtgtgtgaaagcgccatactcaccctgcgggagatgggcatccaggccgagtgggtggacagcgggcacaaggccgtggagcaggtccgcgtcctctgggatcggggccggtattacgatctgatcctgatcgactggaagatgccggagatggacgggctggagacggcccggcgcatccgtgccatcgtgggaccggaggtcaccatcatcatcatgaccgcctatgactggaccgccatcgagcacgaagccaagctggccggggtcaatctgctgatgagcaagcccatgttcaaatcctccctgatctctgccttctccaaggcgctgggggagaaggaggagcgcacgcagccggtgcaggagcccgactacgacttcacgggcaggcgggtgctgctggcggaggacaatgcaatcaacaccgaggtggcggtgctgctgctggagagcaagggctttcaggtggatacggcggaaaacggcctgcgcgctctggagatgttcagcaagacggagcagggctactacagcgccattctgatggacatccgcatgcccctg

SEQ ID NO: 2469 - DNA, 1071 bp, Unknown
  Description of Unknown: Intestinimonas sequence
atgcaaaataattttggtcgttttgttgctcgtcaagtgaaagcttttcttatacaatacattttaggggaagaagcacgttggttcggttacgataggaggttttccgtggaaattcatcatctaaggtatttcgtggaaattgcccgaaacaagagctttactcgggccgcagagcagctttatattacccagcccatgctaacccgggtgatcaaacaattggaagaggagctggatgctaagctgattgagcggaccagcaagagcttccggctgactgacgtgggggaggcgttctaccttcaggcccaggacctgctattgcgctacaatgatttataccggaccattgacgatgtcagatcggttcgcagcggcgaggtacgcctgagcacgccgggggtgctgctggatatgtattttgctccgctgctggcgcagtttcgaaataaatttcccggtattgacattaacattgtggaggagggctctaagctagtcgtaaaagccctactgtccaaccaggcggatttgggaatggttatgctgcctgtcgagcattcctcccaattcgagaccacggtggtggtacgggatcaggtccggctgatggtgggcaagggacaccggctggccggctgcggccaggtccatattcgggaactaaaagaagagcggtttattacatttggtgacacagccacgctgcatgaccaattcatccatttgtgcgaagaacataatttctatccacatgtagcctataaaagtttgatgccgcacttcacagcggaactgctggcctccagcgactgcgtggcagtcatgccgggccctgtgattcagagataccgcaccgatgaattggccgtgctttcgcttgaacagagtcttccttgggaaattgccgtcattcaccgcaaggagtgctaccaatcctatgcctccaacaagctccgggagttcatctgcgactactttgccgccctccagaaggccgcagtccctgttgtcggaacgcccgcgccgcgggaggggcagaacattttttccggtgtttgcgattga

SEQ ID NO: 2470 - DNA, 1269 bp, Unknown
  Description of Unknown: Intestinimonas sequence
atgcaaatcgcgtacggaaccagcgggataccctgggtgcggagcctggagggcgtggaggttctggagtccgggatcggcgagctgaaggcgacgaagagcgaggacgagctggtgctggaggccatggccaagcccatcgactctcccaagctgtccgagctggccaagggcaaaaagacctgcaccatcatcatcagcgaccatacccgtccggtgcccagcaagcacatcattcccttcatgctcgccgagctgcggcagggcagccccgatatcgacgtcaccctgctggtggccaccggcttccaccgccccaccagcaaggacgagctcatccaaaagctgggcgaaaagatcgtggcggaggagaagatcgtcatccatgacagccaggacccggccagcaacgtggagatcggcgtgctgccctccggggcccggctggtcatcgacaaggtggcggccgagaccgagctgctggtcagcgagggctttatcgagccccacttcttcgccggcttctccggcggccgcaagagcgtgctgcccggcgtgtgcgatcaggtgacggtgctgggcaaccactgcgccaagttcatcgcctccgactgcgcccgcaccggcgtgctggagggcaaccccctgcacatcgacatggtgcaccccgcccggcaggccaagctggcctacatcgtcaacgtcatcatcgacgaggacaagaaggtagtcgccgcctttgccggcaactacgtcaaggcccatgagaccggctgtgcgttcctgaagggctactgccgggtgaagccacagaagcggggcgacgtggtcatcacctccaacggcggcgcgcccctggatcagaacatgtaccagagcgtcaagggcctgaccgccgccgagtccgccgccgctcccggcgccgtgctcatcatctgctcccgctgcaacgacggcaccggcggcgagggcttctaccgggctctgaaggactgcgaatccccggagaagctccaggaggagaccctcaagatccccatggagcagaccaaccccgaccagtgggagtaccagatcctggtgcgcatgatgtgcaagcaccatatcatcttcgtctccgacccctccgccaggcagtttgtggaggacatgaagctggagtacgcccccgacctggagactgctctggaccgggcctacgccctcaagggcaaggacgcccacaccgtggtcatccccaacggcatctccgtcatcgtggaggagtaa

SEQ ID NO: 2471 - DNA, 1362 bp, Unknown
  Description of Unknown: Intestinimonas sequence
atgggttggatggatcaactcaaaaaggcgggcatgtccatggtgtatggctacctggatcaggacccggaccgcaatcttcccaaactgattgattgggcggaccagttggacacgaaaaatgtctacgggcccgcgcggaaacagtttcgcaaggtgattgaagaccctgagagcaattggtatcagttgatcaagagcctctggacggacattgacgatggagtacgcaggaccctgtttgagaacttcatcgtgaatgccagtctgctgggctatcccaagcagatccagaacagcgagaagtacggctgcaatatcccgtgggccatcctgatggacccgacctccgcttgcaacctccactgtaccggctgctgggcggcggagtacggcaatcgaatgaatatggacctggagacgctggattccatcgtaaagcagggtacggagttgggcacttatatgtacctttacaccgggggagagcctctggtgcggaagaaggacctcatcacgctgtgtgagcgccacccggactgcgtgtttttgtccttcaccaatgccacgctcatcgacgaggccttcgccgacgagatgctgcgggtaaagaactttgttcccgccatcagcgtggaagggtttgagcaggccaccgattcccgccgtgggcagggtacgttccaggctgttaggcgggcgatggagatcctcaagcggaagaagctgcccttcggcgtctcctgctgctacaccagggccaataccgatgtcatcggcagcgaggaatactttgatcagatggtggaatggggcgtcaagttcgcctggttcttcacctatatgccggtgggcaccgatgcagtaccggagctgatggtcacggctgaacagcgcgcgttcatgtaccaccagatccgcaagttccgcgaaaccaagccgatttttactctggacttttggaacgacggggagtacgtgtcaggctgtattgccggtggccggcactattgccacatcaacgccaacggagacattgagccctgtgccttcatccactactcggactccaacatccacaataagaccctgctggaggcctaccgatccccgctgtttatggcttatcggcagaatcagccctttagcaaaaactacctgcgcccctgcccgctgttggataactacggccggctggcagacatggtggatcagagcggggcccattctaccgacatggtccacccggaggacgtccacgacttgtgcgataagtgcaaggaagcatcggagcaatggaagatcacggcggatcaactgtgggcatcctcccacggctgcaccggctgcggcgggcagtga

SEQ ID NO: 2472 - DNA, 678 bp, Unknown
  Description of Unknown: Intestinimonas sequence
ctggtggcccactgccaggccagaggcatccccgtgctgcccggctgcgtcaacgcctccgacatgacccgcgcggtaaacgctggcctggaggtggtgaagttcttccccgccgagcagtccggcggcctgagctttctcaaggctctggctcccgtgtttcccaagctgagctttatgcccaccggaggcgtaagcgccaagaatctgatggattatctgggctatgaccgcatcgtggcctgcggcggcacctggatggtaaagaaagacctgattgaagcagagcagtgggatgagattacccgggtgtgcagagaggccgtaaagaccatgctgggcttttctctccaccacgtgggcatcaactgcgccgacgaggcagaggccgaccgcaccgtccggacgctgtgcgccctcttcggctttacctatcaaatgggcaactcctccatcgtggccatgcccgccgtggagtgcaccaaacagccctacctggggactcacgggcacatcgccatcggcgtcaacagtgtggatcgggcggtgtatcacctgggactccagggcgctgccttcgacgaggccacccgcaagaccgacgctaagggccgcaccaaggccatctatctccagggtgagttcggcggatttgccattcatctggtgcaaaaataa

SEQ ID NO: 2473 - DNA, 1044 bp, Unknown
  Description of Unknown: Intestinimonas sequence
atgttcaagaaatttaccaatggctgcgtacgcgtggtcaaccgctggctgccggatgcattcctgtttgctatcattttgaccatcgttacctttgttggctccatgatcggcaccaagcagtcccccattgaactggtcaatgcttggggcaatgataagggcatgtggggcctgctgtccttctccatgcagatggccctggtcctcgttctgggctccgccatggcctccgccaaggtctgcaaaaaggcgctgggctccattgcaagtctggctaaggacaagaaaagcgccattgttgtcactaccttcgtctctaccatctgctgctggctgaactggggctttggcctgatcgccggcgccctgctggccaaggaagtggcccgtcgggtccgcgacgtggactacgccctgctgattgcctccgcctattccggcttcgtcatctggcacgccggcatctccggttccattcccctccagatatccacgggaagcgagatcctgggagtcgtctatcaggtgcccaccagccagaccattttccatcccatgaacctgctcatggtcggcgtgattctggtcctgatgcccttcgtcaactatgctatgcaccctgatgtacagcacaccgttaccgtggaccccgcccggctggtcgatgaggaggatcggacctacaccatcagcccccccgccgaaaaattggagcacagcaaagttctctggatcatcactctggtgttgggcttcgcttacatcatctattattttttcaccagcggcttcaacctgggtctgaacatcgtcaatatgattttcatgttcctgggcattctgctccacggcgacctgcgtaaatatgtggacgccatcggtgatgccgcctccggcgccgccggcatccttcttcaattccccttctatgccggtatcatgggcctgatggtggcgcccaacgccgacggcgtatccctggcctctatcattgccgacttcttcgtcagcgtctccaatgaagtcaccttccccatgctg

SEQ ID NO: 2474 - DNA, 1524 bp, Unknown
  Description of Unknown: Intestinimonas sequence
atggcagagagaacgcgcaaaacagaatcccggtccggtgaccgccgggccaaccggaccatcctgggccgcaccattttcctgatggtgatcttcggggtggttgtctttatcccgctgttctggaagttgtgggacgtgcagatcagccagcacgacaagctggaggagcaggccatcgaccagcagacccgggacctgctggtgaccgcgccccggggcaccatttacgacgccaaaggcaaccggctggccgtctccgccgacgttcacaacatcgtcatctctcccaaggacatcgtggagggagagaaggcggcggccgagcgggcggcggtcaagctggaaaagggcgccggacttacccaggaggagaaggagaaaaagggctgcgtccccaccgacgccgaaattgccgcccagagcggcaattacgccgcattcatcgctcaggggctgtcccagatcctgggggtggaggaggaaaagatcctcaagcgcatggagaacaccgcggtccagtatgaggtggtcaagtggcgggtggaggacgacatcaccacccaggtccggcagttcatcagcgactatcagctctaccccggcgtgtatgtggagccggacaccaagcgctactacccctcctccgatctggccgctcatgtggtgggctgggtcaacgtcaacgacaacaacaagggcgcctacggcgtggaggcccagtacgagagctatctggccggaaaggccggccggggggtcaccgccaaaaacgccgccggcaccgagatgctctccagctatgaaaactacatcgacgccatcgccggcggcgacctgcacctgaccatcgacaacaccatccagagctacgcccagcgggtcatggacgagggcattgccaaatacgatgtgcaggagggggccttctgcatcgtcatggaccccaacaccggcgcggtgctggcgatggcctccagccccgactacgatctgaacagcccacgggagatcaccgactcagtgctgtccagctacgtggagtcggtgaggaacgaccccagctccaacgacgaggcctatgccaaagcccttcaggacgcgcagtattcccagtggcgcaacaaggccctcaacgacacctatgagcccggctccaccttcaagaccctggtcctctccgctgccctggaggagggggtggtcagcgagtccgaccacttctactgctccggcgtgaagcaggtggccaactggcccatccgctgttccaagcgggagggccacggagatcagaccctgcgccaggcggtgatgaactcctgcaacccggctttcatcgagatcggccagcggctgggggcggaaaagttctgggagtacctggagaactacggcctgatggagcgcaccggcatcgacctgcagggcgaggggcagagccagttctgggacgaggaggagttcgtcagcgaacagggcatcgcctccctggccaccgcctccttcggccagcggttccag

SEQ ID NO: 2475 - DNA, 930 bp, Unknown
  Description of Unknown: Intestinimonas sequence
atgtataaattcatcctgctgtttatcgctgctgagctgctgacggcggtgattctggaccatccggccaacatcctgccgggactggtcaaaatcatcacgatgcaggatgtgctcatcaccgactatgtccagatcgccggaccgggggccgccttggtcaactccgccctggtgactctggtcagcaccgtcatcctctatctctgcaaagaccccctcaacggcttcaccattgccctcatcggcctgatgtccggcttttccctcttcggcaagaacattgccaacatctggcccatcatcctgggcacctggacctatgccaggcgccggagggagccctttggtcagcacgtcaatgtggcccttatggccaccgccctgtcgcccctcatcagctacatggctctgggcagccagcacgccaacctcctagtgggcgtcctcatgggcatggtcatcggaggtgtgctgccctctctgtcggcctatacctacaaggtccagaacggcatgaacctctataacatgggctttgcctgcggcatgctggctatgatgatcgtccccatcctcaccgccgctggagactcccccgagaaggtcatgtactgggccaccggctacaacacgaaattcaccgcggccctgtgcatcctgtgcggcgttctcattttttcaggattgttcctgtgcggcaagcccgcctgggccgcatgggccggctaccgccgcctgctccttacctccggccgtgcccccagcgactacctgcgtatgttcggcgctgcccccgtcctcatcaacatgggggtcaacggcctggtggccaccgcgtacatcctgctcatcgggggcgacctgaacggcgccaccctgggcggcatcctcaccgtcatcggattttccgcctacggcaagcacgcc

SEQ ID NO: 2476 - DNA, 1335 bp, Unknown
  Description of Unknown: Clostridiales Family XIII. Incertae Sedis sequence
atgagtaaaaaaatttttattgacaccttgggatgtgcgaagaatgagtacgattcccagaatttagcggcacaactgctggaacggggatgcggcttggcggattcgccggaagaagcggacatcctgattgtaaacacctgcggttttattgaggccgcaaaggtggaatccatcgaacatatttttagcatggcggcactgaaaggggaaagcaagaagctggtggttaccggttgcctttccgaacgctaccacgaagatttgtccaaggagattccggaggtggacctgttcaccggcgtaaacgattacgacgacctgccgggattgctgctggcggagagcaccggcgacaaagtgcagggggaagtggaagcggtgcttccgtatcggaaacgcgtttttccggagggaacctacacggccagcctgaagattgccgaagggtgcaacaacacctgtgcgttctgtgcaattccgaagattcgcggaccgtatcgcagcaagcgtattgaggactgcgtgcgcgaagcggaggacatggcggcggcaggcgttcgggaattggtagtgattgctcaggacacctcgtattacgggaaagacctgtacggcaaggcgatgctcccggaactgctgcacgaattgtgtaaggtggacggaattcggtggattcgtctgatgtacgtgtacgatgacggaattaccgatgagctgattgaaaccatgaagcaggaggataaaatctgcaactacatcgatattccgattcagcacgtggcggatccggtgctgaagggcatgcgtcgaaaatccaccggggattcgattcggaagacgattgcgaagctgagaaaagaaattccggatatccatattcgaaccacaattctcgtgggattcccgggagagacggaagaagatttcaacgaactcctggattttgtagaagaaacacgaattcctcggttgggcgcatttgctttttccgatgaagaaggaaccctgtcctatcggatggaaggaaaactggatgaagagacgaaaaatgaacgtgtagaggtgctgatgcgccttcagtcgggaatcagcgattctctgaatgaagagaaaatcggaaagacctacgaggtgatggtggatgaggccgtggatgaagaggcctgccggtacctgggtcgaactcgatacgatgcgccggaaatcgatgatgcggtggaattcaccggaacgacatcccatcagccgggagatattgtgttcgttaatgtaacagacagttcagaatatgatttgtatggtgaggaggtttcacatgaatttaccaaataa

SEQ ID NO: 2477 - DNA, 894 bp, Unknown
  Description of Unknown: Clostridiales Family XIII. Incertae Sedis sequence
atgcacgcgattacgaatattcagaaattctcggtgcatgacggtgatggaattcggacgacggtgttcttcaaaggatgtcctttgcactgcgtttggtgccataacccggagacccagaagtataatccacagatgcagtttgatgaagcaaaatgcgttggatgcggattctgtatgaaagcctgtccaaacgatgccatcaagattgagaacggcaaggcggtcaccaacccgctgaagtgcatgctttgcggtaagtgcgtaaaggcttgtccgagcagcatccgggatatcctgggacatgaacacgagattcgtcctttggtgaaggaacttctgaaagatcagatgttctacgaagagtccggtggcggagtgaccctttccggcggagaggttatgagtgtcgatccggaatacgttctggcgctggcaaaagaattgcaccgtcagggcatcgatattacggtggacacttgcggtgaggcgccatacgaacggtttaaggcaatgctgccgtacgtaagcaccttcctgtacgatgtgaagtcgatggatccggagattcacaagaaatacgtgggggctgacaacgcccggattttggacaacctgtgccggctgagcgcagacggagctcgaatctacatccgaattccgatgattaaggaagtcaacgccacggaaaagaacattcgggcaaccatcgatttccttcataaaaacaacattcatgtcgctcaggtcaacctgcttccgtaccataataccggatgcagtaagtacccgagaatcggaatgacatatgaaggtgcggacctgcaggcaccgacaaaagaagaaatgcaggaatttgcagagatgttcaaagaagcaggatatgcgaatacc

SEQ ID NO: 2478 - DNA, 996 bp, Unknown
  Description of Unknown: Clostridiales Family XIII. Incertae Sedis sequence
atgaccttacttgatgcgttttcgctgcttggaggtgtggggctgttcctttacggtatgaccgtcatgtcggcgggactgaaggatgcagccggagacaatcttcaagcgattctggagaaagcgacgtccaataagataaccgcggtgttcgtgggaatggtgatgaccattctggtgcagagttcttcggcgacggacatcatggtaatcggttttgttaactcgggaatgatgaccttgttccaggcgctgggcgttatcatgggcgccaacatcggtaccacggtgacggcacagattacggccttcaacctggcggcttacgcaccggtgattatgttcctcggtgtggtggcattcctctttatcaagaacaacacggtaaaatatgtgggcgaggtaatcatgggcttcggaatgctctttgtgggcattaccatcatgaagacggcgattgcccctctgtcccagagcgaagcctttatccgagtgatttccggactggataatccgttcctggcggtactctttggcgtggccttcacggcgctgctgcagagttcctcctcctcgacggttatcttccaggcctttgcggtacagggactgctgagctatcatacggcggtgtacctggtaatcggtgcggccatcggttccgtgacgccgaacctgattgcgtccctgacggtgaaccggaacggaaagcgttcggccattctgaacctggtgtttaacctgattcgtgccgtggtgctgatgattctgattgcaatcttcccacagattctcaccgcaatccaatctctgtccccgaacgacatcggaagacagattgcgaatacccacacgatgttcgccattatcgcggtaatcatcgagctgccgttcatgaagtatctggtaaaaatagtagaacgtctcatcccggtactgccggaagagaacgaacggatgatggatcgttcgctgcagtacatgatcaatgtgaag

SEQ ID NO: 2479 - DNA, 777 bp, Unknown
  Description of Unknown: Clostridiales Family XIII. Incertae Sedis sequence
atgatcacactgggaattgatatcggatcgacaacatcgaaatgcattctccttcgggatggaaaagaaatcatcggaaaaagtctccttgtgggaggtatgggtacggacagtcccaagaaagcgatggataccgtcctgaaggagtgtgaaataacacccgaggacgttgcaagaacgattgtaaccggatacggaagaaaaaattttgaattcggcgacggcgaggtcagcgagctgacctgtcacggactgggcggaaggttcgttttcccggaactccgaagcgtcattgacatcggaggacaggatgcgaaagtcatcgtcttgtcggagagcggcagaatgtccaacttcgtcatgaatgacaagtgtgcggcaggcacaggacgttttctggatgtgatggcaacgattctccaaatggacattggcgactttgatgcctgtgcagcaaaatccagcaatccggcctcgatctcaagcacttgcacggtgttcgctgaatcggaagtcatcagccagctggcaaatggggtgaaacgagaagatctgattgcaggaatctgcagcagcgtggcagcccgggtgtccgcactggcaaggagggctggcgtaacgcctatggtgtgcatgtccggcggagtggcaaagaacggtgctgtacgaagagcattgtccgaaagcttggacatggagatcgcggtggatccgctggcacagtacttcggtgctatcggcgcagcactgtacgcatatcgacaagcgataaaatag

SEQ ID NO: 2480 - DNA, 714 bp, Unknown
  Description of Unknown: Clostridiales Family XIII. Incertae Sedis sequence
atggaaagtaaagtcaaaaatcatgatctgagttttctctcttccaatgattactggggcagaggcattatgattggcacaagcggccgtcggattgctgttgcctattttatcatgggaagaagtgaaaacagccgaaaccgttacttctatcaggaaggggacaaggtggcaattgcaccgtacgatccggcaaagctggaggacccgaccttaatcatctattatccggtaaagaccgttggaaatcagctgattgttaccaatggagatcagacggataccgtagaagaacatctgaatcagggaggcactttcgaatccgctctgcgtactcgggagtttgagccggacgaacctcattttacccctagaatcagcggaatcgtggatatgacggatggcatgttcaagatgagcatcctgaagaatatcgacggtatcggcaaggaatgcggccgttatttctatgaatatgcgccggtggacggaaccgctcgtttcatccacacctatgaaggaaatgccactccgctgccgacattcgagggagaaccttggaaagtggagattccggaggatttggacgtattcaccgaaaccatttggaagagcctcaacgaggacaacaagatttcgctttgcacaatgatgattgatatggacaccaacgaaaaggacgttcgtattctgaacaagagaatgggagactag

SEQ ID NO: 2481 - DNA, 795 bp, Unknown
  Description of Unknown: Clostridiales Family XIII. Incertae Sedis sequence
agccggcttccggtgctggaggaagtgtttgcggatatcggagatgagcaaagcatcgagcagagtctcagtacgttttctgctcatatgaagaacatcacggaaatctttcggacggtaaatgagaagtctttggtactgctggatgagctgggttccggaacggatccggcagaaggtgcggcgctgggtatcgccgagctggaagaacttcggaagcgcggggctttggtggtggctactacccattacacggagctgaagaagtatgcgctgagcaccccggaagtggaaaacgcctccatggagttcgatgtggagacattgtctcccacctatcaccttcgagtcggcctgccgggaaagtccaacgcctttgaaatttcgagaaagcttggtctggaagagaaaatcctccgaagagcggaagcccttctgggagaaaacgagctgaatttcgaggatgcggtaactcgggtagaggaagagcgaaaagaagcggaacggattaccgaggaagccaatcggattaaggaggaagcggagcagcggctgcaggaagcggaagcgcaaattcgccgggccgaaaaagagaaggcgaaaatcctggcggatgctcgaaatcaggcgaaaggcatcctaaaagaaaccgaggacacggtggaggatatccgggaagagctgaagcggatgaaagacgaatccaagggtcaccaggtgaacaaagtggcggaaagccggcggagacttcgggaagccgaaaagaagtaccgggataagccggcggcaattccg

SEQ ID NO: 2482 - DNA, 1260 bp, Unknown
  Description of Unknown: Clostridiales Family XIII. Incertae Sedis sequence
atggccgagaaagtaattatgtcgggtaacgaggcaattgcccgcggagcttatgaaggtggctgcgtattcgcatctgcttatccaggaactccaagtacagagattctcgagaacatgccgcagtacaaggaaaacgtgtactcggaatgggctccgaacgagaaggttgcggcagaagcagcaattggtgcttccatcgccggtgttcgttccttctgtgcaatgaagcacgttggtctgaacgtagcagctgacccagtattcaccgtagcatacacaggtgttaccggtggtctggtaatcatttctgcagacgatccgggacagcacagttcccagaacgagcaggataacagaaactatgcaaaggcagcaagactgctgatgctggaaccgtcttccagccaggaatgtaaggactacatgaagatggcgttcgcactgtctgagaagttcgatgcaccggttctgttccacgtgacaactcgtgtatgtcactccaagggaatcgttgagctgggtgagcgtgttgaggcagactacatcccttatgagaagaagattacaaagtatgtatctgcaccggcaaacgcaaagaagatgagagtcaatctggaaacaaagctgcagatgatggaagagtatgcaaatacttgcgaaatcaaccagccggaatggcatgacaagaagatcggtgtggtaacatccggaatttcctatcagtatgcaaaggaaaccttcggtgagaacgcatcttacctgaagctgggtatgaccttcccgctgccaactaagctgattgaagacttctgcgcacaggttgagaaggtatatgttattgaagaaatggatccgtatctgcaggaattcctccagattcacggaattgagtgcgttggaaagccggttattccgaccttcgacgaactcaacacagatatcgtaagagaagcactgaccggtgaagttccggaatcctatgaatccgaactgaagtctgtagtaagacctccatcactgtgtgcaggatgtccgcacagaggcttcttccaggcaatcaagaagaagaagaacctcatgatcaacggagatatcggatgctacacactgggtgccaacgctcctctgaacgcactggataccgcaatctgcatgggtgccagcctgtccatggctcacggtgcatctcaggcatataagatggttggtgcagagacaaaggcagttggtgtactgggtgactccacattcttccac

SEQ ID NO: 2483 - DNA, 1158 bp, Unknown
  Description of Unknown: Clostridiales Family XIII. Incertae Sedis sequence
atgccaagagaattttctttggagaaaacaagaaacgttggtatcatggctcatatcgatgccggtaagaccacaacgacagaacgtattctgttttacacaggaaaaacgcacaagatcggtgaaacacacgatggtgcagctaccatggactacatggcccaggagcaggaacgtggtattaccatcacctctgcggctactaccgctcagtggaaagacactcgtatcaatattatcgacaccccgggacacgtggactttaccgttgaggtagagagatctcttcgtgtactggacggtgcggtaatggtactcagtgcgaaagagggtgtagagcctcagtcagaaacagtttggagacaggctgagaagtataacgtaccgagaatgatcttcgttaacaagatggacgttctgggtgcggatttcttccacgttctcgacacaattcatgatagattaagagcgaatgccgttccggttcagatgccaatcggtgcagagaaccagttcgtaggtatcatcgacctgatcaccatgaaggcagaggtatatgacagagacgttcttggaaccgaatttgatatcgtagatattccggaagacatgctggaagaggctcaggtatggcacgataagctggttgagtctgttgcagagtgtgacgaggaactcatgatgaagtatcttgagggtgaagaaatcaccatcgacgagatcaagaccacaatccgtaaagagacactgaagggcgagatgttcccgatgttctgcggatccgcatacaagaacaagggtgttcagatgatgctggacggtatcgtagattacatgccatccccactggacattccggctatcaagggtattgacccggataccggagaagaggatgaaagacactccagcgataaggctccgtttgccgcacttgcattcaagattgttgctgacccgtttgttggtaagctggcattcttccgtgtatactccggaactctgaaggcaggttcctacgtatacaacgcaaccaagggcaagaaggagagaatcggccgtatcatgcagatgcatgcgaaccacagacaggaaatcgagatggtatactccggtgacctggctgccgctgttggtctgaagcagaccaccaccggt

SEQ ID NO: 2484 - DNA, 1389 bp, Unknown
  Description of Unknown: Clostridiales Family XIII. Incertae Sedis sequence
ccggtgatcggaagagacaaagaaatccgtcggaccatcgaaatcctgtccagacggaccaaaaataacccggtactgattggtgaaccgggtgtaggcaaaaccgccgttgttgagggattggcacagcgaatcgtaaacggagatgttccggagaacctgaaggacaagaccatcttttccctggatatgggatctctgattgccggtgcgaaataccgaggtgaattcgaggaacggctgaaggcggttctgaatgaaattgacaagtccgacggcaagattatcctgttcatcgatgaaattcataacattgtaggtgccggaaaaacggaaggttccatggatgccggaaacctgctgaagccaaagctggctcgaggcgagcttcactgcatcggcgccaccactttggatgagtaccggaagtatatcgagaaggatgcggcattggagcgtcgtttccagaaggtaatggtggatgagccgagcgtagaggataccatttccatcctgcgtggtctgaaggaaaagtttgaaatccaccacggcgttcgaattcaggataatgcgctgattgcctgtgccaccctgtcaaaccggtacatcagtgaccggttccttccggacaaagccatcgatctgatggatgaagcagcggcacgaatccggaccgaaatcgacagcatgccggcggaactggataccatttcccgtaaaatcatgcagctggaaattgagaagcaggctttgtcgaaagaagaagataagggcagcaagactcgactggaaacgattgaaaaggaactggccgacctgcagtcagacaacaacgagctgcgggcaaaatgggaaaatgaaaagcagggaattcagaatctgaaagcaaagaaacaggagctggaagaactgcgtcacgaaattgaaaccgcagaacggagttacgatctggagaaactggccaaactgaaatacggcgaccttccgaagctggagaaggaaatcgatgcgctgaaggaaaaggtcaataaggatcaggaacacaagctcctgaaagaggaagtaggagaagaagagattcgggaggttatttccgactggaccggaattccggcttcccgtctggcagagacggaaagagagaaactcctgcacttgaaagacattcttcatcgacgggtcatcggccaggacgaaggcatcaatgcggttaccgaagccattcttcgggcaagagccggtttaaagaatgaaaaccgcccaatcggttcctttattttcctggggccgacaggtgttggtaagacggagctggcaaaaacactttgcgaaaccctgttcgataccgaaaagaacctgattcgaatcgatatgtcggagtacatggag

SEQ ID NO: 2485 - DNA, 657 bp, Unknown
  Description of Unknown: Clostridiales Family XIII. Incertae Sedis sequence
atgagctacatacagacaattacaccggcacttttgcaaggggcaatcatctcattggaattatttgcgttgacgttgattttttccctgccgctggggctgcccatcgcattgggcgagaattcgaagctgtcgccccttcggtggttctgtaaagtgtacgtacttgtttttaggggaacgccgctgatgttgcaattgttcttcttctattattttttcccgatttgcctgaacattcgtatggatgcgtttccgacggcggtaatcaccttcgcgctgaactatgcagcgtattttgcggaaatttaccggggcggaattaagagcatcgatgcgggtcagtacgaagccgcgcattccctgggattgagccggagtcagacgctgttcggcattattttgccccagacgttccgcatcgtgattccgccgatttccaacgaaatcatcgttctggtgaaggacacggcgctggcgtcggcaattgccctggcggatattatgaaagtctccaaaagcatcgtgaacagagacggttcgctgatggcgtatgtaatcgcggcggcgatgtatctggtgttctccttcctggtgacatgcctgctggagagattggaaaagaagacgtctttgtacgacggaaaggaggcctag

SEQ ID NO: 2486 - DNA, 1191 bp, Unknown
  Description of Unknown: Clostridiales Family XIII. Incertae Sedis sequence
atgccaagacctgtaaaagttggtaggaaagaacgcatgacctttgccaagatcaatgaagtttgcgagatgccgaacctcattgacgtgcagacacagtcctataaatggtttgtggaagaaggtctgtcagaggttctggaggacgtttccccaatccgggatacaacgaataccctcagtctcgagttcgccgactaccatttttccgaagaaaccaaatatagtcaggaagaatgtaaagaacgggagaccacgtatgcaacatctcttacggtaaaggtacggctgattaaccgcgagaccggtgagattaaagagcaggatgtcttcatgggcgagtttcctctgatgacagaaaagggcacattcatctacaacggtgcagagagagccatcgtcacacagctggttcgttctccgggaccgtattttgaagtattagtggacaagtccaatcagaatctgttctcttctacgattattccgaaccgtggtgcatggttggagtatgaaacggattctgctggcatcatatatgtaagagtagaccgaacaagaaaattaccgattaccgccttcctgagagcattgggtctggattccaaccaggatattctggacacctttggcgatgacgacagactgattcgtacgttggagaaggataacaccaagaacagcgatgaaggcgtgaaggaaatatatagaagattaagaccgggagatccgccaaccgttgagaatgcgcgttccatgctgaactcccttctcttcgatgcgagacgctacgatctggcgaaagtcggaagatataaatacaataagaagctgggaattcacaacagactggtgaactcctatgcggcagaggatatcatcgatccgaacaccggagaaatcctggtggaaaaggatggatttatttcccgtgcaaaggcatatgaaatcgagaatgccggtgtactgagcgcactgatccgcagcaagaacgagaatgatgattccgtcgctaaggttatcggaaaccagttcgtggatccgaccggatacgtggacatcgacctggcaccgtacaagctgtctgagctggtttactatccggtgctgaaggatatcattgacaatgcggagaccgaggatgatctgaaggcggcaattgccagccggaagcacgagctttctccgaaa

SEQ ID NO: 2487 - DNA, 1074 bp, Unknown
  Description of Unknown: Clostridiales Family XIII. Incertae Sedis sequence
gtatggctgttgtccggaaccattccgaccatgatttattacggtctgacattgctccgcccgtccatcttcctgattgcggcggtgctgatttgttccatcacttctctggcaacgggtacttcctggggaaccatgggaaccatgggtcttgcactgatgggaatcggtcacgggctgggaatgccggtgggaccgactgccggagcgattctggccggagcgtatttcggcgataagatgtcgccgctgtccgataccacgaacctggcgccggcaatggccggaacggacgtgttcactcacgtgaagttcatgcttcgttccactctgttcacttatgcaatcgcactggtattcttcggatttatcggattccgatttgcatccggaggaaccgcagatacctcccaggcacagatgctgatggaaggacttaaaaacaatttcaacatcaacccgatattgcttctgccgccgctggtggtaattctggccattgcattgaagattccggccattccgggaatcacgttaggactgctttctgcagcggtgatggcaccgattttccagggaaatctgaagattttcagtgactcgctggaatacctgcataccggcgttacctttggtgatattctgagtgttggcagaaacggcttcttctgcaagacggaagtggatgcgctgaacagcctgctgaccaccggaggcctgatgaacatggcttcttccattctgatgaccgtcatcgccatgatgtttggaggaatcatggaaggtaccggacagctggcggtagtaatcgaagcgattatcaagaaaattcacagtgcagcgggtctggtgggcgtaacggaactcacctgcttcctgtccaatatcgtgatgccggaacagtacatctccatcctggttccgggcagaatgtatgcaccggcataccggaaggaaggcctgcacccgaagacattgtccaacgcactggaatctgccggaacggttacatcctgtctcgttccgtggaatacctgcggaatgttcattgccaccacgctgggtgtaaccacc

SEQ ID NO: 2488 - DNA, 1197 bp, Unknown
  Description of Unknown: Clostridiales Family XIII. Incertae Sedis sequence
atttccatgattcgagacaaaaacctggatgtccgtaccaccaccatgggcgtctctctgctggactgcgcggacagcgacatcgaccgctcctgcgagaagatttatgagaagatctgccgaaaagcggaacacctggtggaaaccggcgaaaaaattaccggaaagtacggaattccaattgtgaacaagcgggtttccgttacaccgattgccatgctggccggtgtatccggcggcgacccggtgaaatacgcacgcacgctggatcgagcagctcatactgtcggaattgattttatcggcggatattccgcattggtacagaagggcttcagcgccggggaccgggaactgattgaatccatcccacaagctttggccgaaacccagttggtgtgctcctcggtaaatatcggctccaccaaggccggcatcaacatggacgccgttgctcttatgggccgacaggttcagaaagccgcactcctcaccaaagataaccagtgcatgggcgctgccaaactggtggtattctgcaatgcggtagaggataacccgttcatggccggtgctttccacggcgtgggcgaagcagattccgtcctcagcgtcggcgtatccggtccgggcgtggttcggtccgtgctgcatgaccttccggacgatgcaccgctgaacgaggtggcagaaaccattaagaaaacggcatttaagattacccgtgtcggtcagctggtgggttccgaagccgctgccgcattgggcgtaccgttcggaatcgtggatctgtccctggcaccgactccggcaatcggcgattccgttgcccgtattctggaagaaatcggcctggagcagtgcggtactcacggtaccaccgccgcactggccatgctcaacgatgcggttaaaaagggtggcgtaatggcctcctccagtgtcggcggactctccggcgcatttatcccggtaagtgaagacgagggcatgattgccgccgctcgcagcggaaacctggttctggagaagctggaagccatgaccgcagtatgctccgtaggtctggacatgatcgtgattccgggagataccactccggaaaccatctccgccatcatcgccgacgaagcggccatcggtatggtgaacagcaaaaccacagctgttcgcgttattccggccatcggcctgaag

SEQ ID NO: 2489 - DNA, 957 bp, Unknown
  Description of Unknown: Clostridiales Family XIII. Incertae Sedis sequence
atggctaacgaagcaaaaaaagaacgtattcttgttctgaacctcggttccacatccagcaaaatcgctgtgtatgatgataccgaagaagtattcaaggaaaccattcgtcacacacaggaagagatggcacagttcagcgatattctggaccagttctccttccgtaacgaaaaggtaagaaatgcgctggagagcaacggcatcggcgtgaacacactgactgcagtatgctccagaggcggaaatatcatcgcatgcccgcacggtgccatcggcatcgatcaggagatgatcgattatctgaccagaccggaagataccgcaaagcacgcatccctgctgggaagcatgattgcatttgacttgcataaggaattcggtattccggcatgcatctacgatgccatcggaaccgatgaaatgcagccaatcgcaagagttaccggacttccggaaatcccacggttcaccgttggacatacactgaacactcgtgcaatggccatcaagtgtgcagaagaagtactgaagaagccgtttaatgagtgcaccttcatcgttgctcatctgggtggcggaagctccatccgtctgtatcacaagggcgtaaacattgactgtgtgaatgatgacgaaggaaacttctctccggagagaggcggcggctgcagcggcaaggagctggtaaagctgtgcttcaaggagttcagcgaaggtgccggcgagaagaccgtaatgaagaagatccacggaaacggcggtctgaaggcacatctgggcacgaccgacgccatcgaggtagagaagagaatcgaagccggcgacaagtatgcaaaggttgtatatgatgcaatggcatacagagtggcaaaagacatcggcaccctgtccgtaccggttgcaggaaaggttgaccgcatcatccttaccggcggtatcgcatactccaagtat

SEQ ID NO: 2490 - DNA, 759 bp, Unknown
  Description of Unknown: Clostridiales Family XIII. Incertae Sedis sequence
atgggaatcaagaaatacaatccaacatctccgggcctcagaggaatgacggtttcgacattcgaggaaatcaccactgataagcctgagaaagctcttacagtcaccctcaagaagcacgcaggaagaaacgtaagaggtaaaatcaccgttagacacagaggcggcggtacaagagcaaagtacagaatcatcgatttcaagagaaacaaagatgacattccggcaactgtaaagagcattgagtatgatccgaacagatctgcaaacattgctctggtatgctacgcagacggtgagaagagatacattatcgctccgaacaagctgaaggtcggcgatgtaatcgtatccggtccggattcggatatcaaggttggaaacgcacttccaatcgctaacattccggttggtaccattatccacaacatcgagctgaagccgggcaagggtgctcagatggtaagatctgccggtaacggtgctcagctgatggcgaaggaaggcaactatgcacaggttagactgccatccggcgaagttcgtatggtaagaatcaactgcagagctaccatcggcgaagttggaaacatcgagcatgctaacatccagattggtaaggctggacgtaagagacacatgggttggagaccgaccgtaagaggttccgtaatgaacccgaacgaccacccacacggcggtggtgaaggcagagctccgatcggacgtaagggtccggttactccatggggtaagcct

SEQ ID NO: 2491 - DNA, 714 bp, Unknown
  Description of Unknown: Clostridiales Family XIII. Incertae Sedis sequence
ctgcggaagggactttttttgtaccttccgtttcaagaaggaggaaaccaaatgattattactttgaaagacggaagtacccgtgaatacggagaaccgatgtccatctacgatatcgcgaaggatatcagcgagggtctggcccgtgttgcctgcgtgggcgaggtaaacggtgaggtgaaggacctgcgtaccgtgattgacagcgactgtgagctgaacattctcactttcgattccgatgcgggcaaacacgcgtatcgccacacctgttctcacgttctggcggaggcggtgctgaacctgtatccggaggcaaagctggccatcggaccgtccatcgacaccggattttactatgacttcgacatgccgccgctgacccgggaggatctggacaagattgagaaggagatgaagaagatcatcaagaagggcgaccgtctggagtactttacactgccgagggaagaagcgattcagatgatgaaggatcgggaagagccgtacaaggtggagctgattgaggatctgccggagggcgagaccatttccttctatcagcagggtgatttcatcgaactgtgtgcgggtccgcacctgatgagcaccaagcagatcaaggcgttcaagctgacttcttcttccggtgcatactggagaggagacgagcacaacaagatgctcaccagaatctacggaaccgcgtacacc

SEQ ID NO: 2492 - DNA, 618 bp, Unknown
  Description of Unknown: Clostridiales Family XIII. Incertae Sedis sequence
ggtgccggaaatctgattttcccgccgttcctgggaagagacaccggttcttcctggttcgttggattcatcggattcttcctgatggacgttggtctggcggtagcagcgattattgcaaccgtatctaacaagaagggcggcgttgacggcgttatgggcaaaatgggccgtatcccgggaaaagcgatggtaaccgctatcatcatctgcctgggaccgctgattgcaattccgcgtacggcagcaaccacctatgaaatgggcgttaagctgttgattccgggtcttccgcagtgggcattcggtgctattttctacggaatcgcactgcttctggtaattcgcccgacaaaagtagtagatattatcggaaactatctcacaccgattctgctggcagtaatggtactgctgattgtgatcggtatcgttaatccgatcgacgaagccgcaatcctggcaaacgcatctccgatgcacgacggtatcgtaaacggataccagacactggacggtatcggcggcgttccgcagacactgatgatgattactgcggcatgtgcttacggatacaccacaaaggatgaaattcgtcagactgtcagcggttccgca

SEQ ID NO: 2493 - DNA, 588 bp, Unknown
  Description of Unknown: Clostridiales Family XIII. Incertae Sedis sequence
atggctagaaatagagaaccggtactgaagagagcaaaggcacttggcattgagcctcagtacctgggaattaataagaaatcgaagagacaggttcagcagagcagaagaaagaagagcgagtacggtattcagctgactgagaaacagaaggttaagttctactacggacttcaggaaactcagttcagaaacacctacgagaaggctaccaagagagccggcggtgcaggtgaaaaccttctgattatgctggagagcagattcgacaatgtagtattcagaatgggatttgctgcaacaagaagagaagccagacagctggtttcccacggacacttccttgtaaacggaaagaaagcaaacattccttccatggaactgaaggctggagacgttatctccgtaaaggaaaagtccaagtcctctccgaagttcaaggagctgagagacatggttatcaccactccacagtggctggatattgacctggacaagctggaaggcaagatcctgactgctccaactcgtgctgacatcgatttaccaatcgaagagcgttacatcgtagagttctactctagataa

SEQ ID NO: 2494 - DNA, 1245 bp, Unknown
  Description of Unknown: Clostridiales Family XIII. Incertae Sedis sequence
cgtccggaacagtccaagaagccatgcttcttcctggaagacaagtacaccggcgagaacgttgcatccaaactggcaagagttcgggcaaagatggcagaatgcggtgctaccgtacacctgattgcatcgctggatgacaatgcgtggctactgaacttccgtggtgacgatatcgacttcttcccactggttctggattatgtaatcgttggcaaagacgatgcacacctgtacatcgacgagagcaaactgaacgacagaatccgtgaagagctggcgaagaacaacgttcagattcacccatataacgacatctacgaagatgccaagaagattggtaaagacgaagtcgctctcatcgacccgatgaagatgaactacgcactttacaagagcctgccatgcaaggtggtagaaggtgccaacccaaccatcctgatgaaggccatgaagaacgaagtggaaatcgcaaacatccggaaagcagagctgaaggacagcgttgccctcaccaagttcatgtactggattaaaaagaactacgacaagatggagatcaccgagttgtccgcatccgacaagctgacatccctccgcgctgaacaggaaggatacattcgggattccttcgaacctctgcaggcatttggtgcacacgcagcaatgatgcactactccccgacagaggagtccgatgttccgctgaaagaaggcggcatgctgctgaccgataccggcggcggctactatgaaggttccaccgatatcacccgtaccaccgttctgggtcatatcacaccggagctgaaaaaatactacaccgcagtatacagagcaatgcagcacctgagcgtagcaaacttcctgtacggaaaccacggctggtccctggatgtactggcaagacagccaatctgggatttgaacaaggacttccagtgcggaaccggacacggattcggttatctgggcagcattcacgaaccgccaaccggattccgctggtacatcgttccgtccaagaatgagcatcaccagttcgaagaaggcatggttataaccaatgagccgggaatctacgaagaaggcgacttcggtatccgtatcgagaacaacctgctcaccgtaaagggcgagaagaacaagtacggtcagttcatgcacttcgagacactgaacttcgtaccgattgacctggacggcatcgatccggaagagctgacacgctccgagagagaatgg

SEQ ID NO: 2495 - DNA, 891 bp, Unknown
  Description of Unknown: Clostridiales Family XIII. Incertae Sedis sequence
gggcttcacgccgattctccggaagaagcattggcacaatcctatgcaaaggatgaaaccgatgaatttgtaaaaccaaccgtcattactccgcagccgattcaggatggagattccgtgatcttcatcaacttccggccggaccgtgcacgggaaattacccggacactggtggatggagatttcgatggttttacccgaaaaaaagtagtacaggatctgacgtacgtgtgcatgacggagtacgatgccaccatgccgaatgttatgctggcatacccgccggaagtagtggaaccgaccctgggaagcgtcatcgccgcccacggactgcggcagctgcgaattgccgagacggaaaagtacgcccatgtcaccttcttcttcaacggcggcaaagaagcgccggaagagggagaggaccggattttggtgccttccccgaaggtcgctacctacgacctgcagccggagatgagtgctccggaggtgacccgccgcgtgctggaggccatcgcatcggatcgatacgatgtgattatccagaactacgccaacccggatatggtgggacataccgggaattttcaggcgacggttcaggccattgaggtgctggacggcttggtggaacaggtggtggacgccatcctggcgaaggacggtcagattctcctgatagcggatcacggaaatgcggattacatgctggacgacaaggacaatgtggtcaccaagcattccctttcccgagttccatgctgccacatctgcaatgagccgcaggcttttgcagtgaacgagggaaagctggcagacgtcaccccgacatttctgacgctgatgggacttccggttccgtcggagatgaagggagatgtgctggtttaa

SEQ ID NO: 2496 - DNA, 1134 bp, Unknown
  Description of Unknown: Clostridiales Family XIII. Incertae Sedis sequence
ttcgcactgcaccttctgccatcgggcattttcagcaaggacgcggtcagtgtaattggcaacggcgtagcggtaaatgcgaagattctggcagaggagctgaagacgctggaagatgccggcgtagagcacagcaagctaatcgtttcggaccgggcgcaagtggtaatgtcctatcacatgcttttggatgcgtatgaagaggagagactggcaggcaaatccttcggttccaccaaggccggaatggcaccgtgctactcggataaatacgcaaagattgggttccaggtgggcgaactgtatgcggacagagagaccctgatgccgagaatcgagaacgtatgccggattaagaacacgctgatggagcatctgtaccacaagccgctgttggatccggaagaaatttacaaagaaatcaaagagaatgcggaaattctgagaccgtacgtggcacatacatccgccgtgctgcaccaggcgctgaaggacgacaagaagattcttctggaaggtcagctgggtgcgctgaaggatacggaccacggtatctatccgatggtcacctcttcctccacactggcaggattcggtgcaatcggtgcgggcgttccgccgtatgcaattcagaagattatctgtgtggtaaaagcatattcgtctgccgtaggtgccggcgcattcgtatccgaactgttcggagaggaagcggatgagctgagaagacgcggcggtgacggcggagagttcggtgctaccaccggacgtccgagaagaataggcaacttcgatgctgtggcaacacggtacggctgcatgatgcagggcgcaaccgaagtggcactcaccgttgtggatgtactgggatacctggacgagctgaagatctgcgtgggctatgacgtggatggagagattaccaccgacttcccgaacaccattcagctggagaaggcaaagccggtatacgaaaccatgccgggctggaagtgcgacatcaccggaattacgaaatacgaagatctgccgaaggaatgcagagactatgtggagcgcatcgaagagctgattggcgttccggttaccatggtttccaacggtccggcaagagacgaactgattttccggtaa

SEQ ID NO: 2497 - DNA, 480 bp, Unknown
  Description of Unknown: Clostridiales Family XIII. Incertae Sedis sequence
atgaaaccctgtgcgcaagggatttttgctttatttttcgggttttttgcccttttctttcgatttttcgtgaaggaagcgctttcaccccgtcaatttgtccattccctatcaatcattgcaccccgctcccccgatggttataatatatttgtaaaaaaaggtttatttttcaacatgttccggcagttcgggatgcatccctctgccgaatcgattactgaaaggaaattcactatgctacagggaaaaaccgtgctgctgggcgttaccggcggcatcgcagcatataagagtgccatgctggccagcgctttgaagaaacagcacgccgatgtgcacgtcatcatgaccgagaacgccactcggttcatcgcacccctcacctttgaaaccctgaccaacaaccgggtttcggtggacacctttgaccggaatttcaaatacgatgtggaacacatctctttggcgaaagccgca

SEQ ID NO: 2498 - DNA, 1398 bp, Unknown
  Description of Unknown: Clostridiales Family XIII. Incertae Sedis sequence
gatgaggtgggcaccaccgttcagctgaccctgcgggacgacaccgaggatgacaaatacgatgagtttctggaggagtatcgcctgcgcagcctggttaccaaatactccgattacatccggtacccaatcgtgatgaacgtggagaagtccaagatgaaggaagcgtcggaggaggaaaaggccaaagaggattatcagccggagtacgagacctaccgggaggacgagcgcctcaacagcatggtgccgatctggaaaaagaagaagagcgagattaccgcggaggagtacaacgagttctacaagtccaaattcttcgactggaacgatccgctgaaggtcatccacaccaacgtggagggcgtgatttcctacgacgccctgctgttcatcccgagtcaggtgccgttcaactactacaccaaggactttaagaaggggctgcagctctactccagcggcgttatgattatggatcactgcgaggatctgctgccggattacttcagcttcgtcaagggtctggtggattccccggacctgtccctgaacatttcccgtgaaatgctgcagcaggaccgccagctgaaggccatcgcccagcgcctggagaagaagatttcaagcacccttctggagatgcaggagaaagatcgggagagctacgacaaaatgttcgaagccttcggtatgcagctgaagtacggtgtctatgaccagtatggcgtacataaggataagctgaaggactttatcgaattctacagcagcactaccgacgagcttgccaccttcaaggaatacgtaagccgcatgagggacgatcagaaatacatctactacgcaaccggcgaatccaaggaaaagattgccaaaatgccgcagatggatctcttcaaggagaagggctacgaggttctgtactgcaccgacgagattgacgagttcgccctgaagattctgcagaactacgacgataaggagttcaagagcatttccgataaagatctgggcttcgagatgagtgacgaggagaagaaggcacaggaagagaagcaagaggaagctaaggacgttctcaccgcggtaaaagaagcactcggggacaaggtagcgtccgtcattctatccactcgtctgaaggatcacccggtatgctttgcctccggcgacggcctctccctggagatggaaaaagtactgaaagcacaggcggagattaccggcaacaaggaagtgggcgccatcaaggcggacaaaatcctggaactgaacggagatcatccgttcttcgctgccctgaaggccgccgtggattccgacaacaaggaaaaggtttcggattacgctcagcttctgtacgatcaggctctgattattgaaggcctgccgatt

SEQ ID NO: 2499 - DNA, 990 bp, Unknown
  Description of Unknown: Clostridiales Family XIII. Incertae Sedis sequence
atcgtagaggtcggaaccggtaagattaaggcgatggtaggcggacgaaaacagcaaggacgtcagctctacaacagagcactgaatccgcgtcagtccggatcctccatcaagccgatttccgtatattcgggcgcactccagaagagttatgacctggcatccgaaggaaagaaattcccgttcaaggataccggccatgaccgacagggcagcaagtattatggcgattacctgaccgcgtcctccgttattgtggatgaacgaatgacctttaacggacagacctggccgcagaacgccagcaactccttcagcggtgcggtaacgatgcgaaaggcattgcaaaattccatcaacgtctgcgccgttaagctggaactccaggtcggtgcggaatacattgccgatcttgtggagaaattcggaatcaccactttagaccgggaaggcggtaccaacgacttgaacccggcagcattggctctgggtggtctcaccaacggtgttattccgctggagatggcacaggcctatgcggcattcccgaatggcggtgtgcgtcaatcctccattgcatataccaaggtcaccgaccgcaacggaaaggtactgctcaccagcaagtctgaatcctcaaaggtgctggatgaaggcgttgcctttgtcatgacagacatgctgaaatccgttgtcagtcagggaatcggatccccggccggaatcagcggcgtacaggccggtggtaaaactggtacgacctccagcgagttcgatatttggttcgatggattcaccccatcctacgcggcagcgctgtggatcggaaacgacgtgaacatgcagctcacttccatgtctggaccggctgcagctctgtggggaaagattatgaaccagattccgaaagcgaagaagggacattataaatcccaaccaagtgacgtaactcacgtcaacggcgaatactacaccaagggaacggaaagc

SEQ ID NO: 2500 - DNA, 849 bp, Unknown
  Description of Unknown: Clostridiales Family XIII. Incertae Sedis sequence
atgaagcagaattatgttcttcaattgaaggcggatatggaatttatggattttttcatggtgaagaccattgccattcgggtgggatccaatcggaaaaaatatctggacatgacattggcggactgcaccggagagatttcggcgaagaaatgggatatttccgatgaagagctggatggcatcaatcgaatccaggtgggcgatatcatcaaggtgaaagccggagtgacggagtggaagggaacgaagcagctgcgcgttacccggattcgccacgccaaccgggacgacggtctggtgcctgccgatttctacaagtcggcgccggaagattcggaaagcatgtataactatattgtaggaaagattcgggaatttcaggatgaggagctgaagcagctctgcctgacaatctacgaagagaaccgggagaggctgatgtactacccggcggccatgagcaatcaccatgcggaatacggcggactgctgtaccacgtgaagcggatgatgatgatgggagagcaggcttgtacagtgtataccaacctctccaaggatctgcttttggcgggagtagtgctccacgatatcgagaaattgaatgagattctgtcggatacccatggtgtgtcgccggggtattcctttgaaggtcagatgctggggcacttggtgcagggcgtgacactgattcacgatcggtgccgggaactgggaatcggaacggagaagaccattcttctggagcatatgattctcagccaccactacgagccggaattcggcagcccgagaaagcctctttttccggaagcggaaatgctccactacttggacattgtg

SEQ ID NO: 2501 - DNA, 2460 bp, Unknown
  Description of Unknown: Clostridiales sequence
aatataatcggcggactggatcgctataccgacggcgacctgattattgccggaaaatccacaaagcagtttcgtgacgcggattgggacaattaccgcaatcgttcgataggctttgtgtttcagagttataaccttatcccgcatcaaaccgtgctgtccaatgtcgagcttgcgctgacgctttcgggcgtttcaaagcatgaacgccgtgtgcgcgctaagcaggcgcttgaaaaggtcggactgggagatcagctgaaaaagaagcccaatcagatgtcgggcggtcagatgcagcgcgttgcgattgcacgcgcgcttgtaaataatcccgaaattctccttgccgacgagccgaccggcgcgcttgattcggagacctctgttcaaataatggagctgctcaaggaggtcgcaaaagaccgccttgtcatcatggttacccacaatccggagcttgcgcagaagtattcgacaaggatcatacgcctgcttgacggcgaaataacggacgattctgatccgtataccgatgaggaggccgcacgtacggtcgcggcggagccgaacaggaaaagcggcaaaaagaaaaagccgtcaatgtcattttggacagcgctgtctctttcggtaaataatctgctcacaaaaaaagcaagaacaatacttacatcctttgccggttctatcggaattataggcattgcgcttataatgtcggtatccaccggtgtacaggcatatatcgacagcatagagcgcagtacgatggcaagctatccgataaccatcagcgagaccactatggacacttccgctatgcttagtgcatttatgaattccaacagtaaggagaatgaggtacaggaggaaaacacggtttattcaaatgatgttgtcgtgcagatgatggagtcgatgacggccggagtaaccaccaataacctaagggatttcaagacgtttttagattcaagcgaggatattaaaaacgactgctacgatataaagtatacctatcccaccggcatgaacgtataccttgaaaacgatgacggaacatacactaaggggcttatggacatatatgagctgtatgacgccatgggcatggatacgggaagtgcatcggatatggtgtcaatgtcttcctccagtgtgtggaccgagcttgtgggagacagggattatatcaacgacagttatgatgttttgtacggacatctgccggaaaataaaaatgaagtggttcttatcgtaaacgataaaaaccaggtatccgattatactctgtattccctcggtctgcgtgatgtcgaccagctaaaagagtatttagaaagcgctcagaaggcggttgccgagggtaaggaaaacgaatataagcttgaaacgcgcaattatacctttgaggaactgtgcaatcagactttcagcgttctgacagatgcagactactataattacgatgatgaaaagaaactgataagcgaagcgtcggaggcggctgttattgaccgtttgaaaaccgcaacaaagcttaaaattgtaggaattgtacgtccgtctgatgaagatgaggcaaaaaggcatgagggtactatcggatataccaccgagtttatgaatgagcttataaacaatgtcaatggcaatgctgccgttaaagctcagcttgacaacagccagacagacctgttttccggtctttcctttgaaaaaaaagaatatacggcagacgaaatacgcgcccatattgcaaacgatcccgagatgagccagtacgtccaaatgccggacgatatgcttttgcagtacggagcggcgatgatggaaacaagcgccacgtatgaaggcaatctttcacggctgggctatgttgaacgcgaaaagccgtcgggaattaatctttatcccaaggattttgaggcaaaggaacgcgtaactgatgccattgaggcgtataacgataaggtggatgaggctgataagataacctacactgatatggtggcaatgcttatgagctctgttaccactattgtaaacgctatttcctatgttctcattgcgtttgttgcaatatctttaattgtatcatctataatgataggtattatcacttatatttcagtactggagcgtacaaaagaaatcggtattctgcgctcaatcggtgcctccaagcgggatatttcccgcgtattcaatgcggaaaccacaattgtcggactgacggcgggcgttataggtatagtaataacactgcttctgctgatacctattaatatgatactgcacacgcttacgggaatctcgacattatctgcaacgttgcccgttctcggcgcggtaatacttgttgcgataagtatacttctgacctatgtggcgggtcttattccctcgggctttgctgcaaaacgcgaccctgttgaagcgctgagaacagaataa

SEQ ID NO: 2502 - DNA, 675 bp, Unknown
  Description of Unknown: Clostridiales sequence
cttgttaaaaatcacgatggctttcccgtgtgggtggatagccctatggcggttgaaacgacaaatatttattcggacgatatgaccgattattatgatgaaaaaacccttgaactattaaagtcgggtgttaatcctataatttttgatgatttgaatcttgccgtatcaagcgatgagtcaaaaatgattaattttgacgagactcctaaggttattctttcagcttccggtatgtgtgaggcgggcagaatacgtcatcatttgaagcataatttgtggaagagcgaaagtacaatactgtttgtaggttatcagtcggagggtactcttggcagaaagctgttggacggtgaggaaactgttaaacttttcggtgaggaaattacggttcgggcacaaatagccaagatggacggtatcagcgggcatgccgataaaaacatgcttcttgactggcttaaaaatcttaaaaataagcctgaaaccgtgtttgtaaatcacggtgacgataccgtgtgcgacgaatttgccggcgaaattataaaaagcctcggatttccggaggctattgcaccgtataacggcgctcagtatgatattttgaaccatgtctgtatttacggcggaaacaaaaatcagattgcgaaagatggaaggttcggttttaaggtc

SEQ ID NO: 2503 - DNA, 1068 bp, Unknown
  Description of Unknown: Clostridiales sequence
gcaagagaacgtgtcagaagcgcatacagaaattctggatttatttttcccgcaaagcgaatcaccgtaaatcttgctcctgccagcattagaaaagaaggctctgtgtttgacctggcaatactgctcggaattctcagcgcttcaggcagcgtcaaaataaataccgatgactgtgcttttgccggtgagctctcattaatgggagatatacgaaaaacaagcggtattcttccaatggttaccaaggcgcgggaaatagggctgaaatcaatttttattcccgaagagaataagggtgaagctgaatatattgacggaatagacatatacccggtaaacaatgtatgtcagctgcttgcgcatctcagaggagatgaaaaaatagagccccttgaaattaagcagttttgcattgacaaaaataattattctgatgtcgattacagcgaggtaatgggacaatatgcagcaaaacgggcaattgagattgctgccgcgggcggtcataatctgcttatgattggtcctcccgggagcggtaaaagcatgctcgccaagcgtatgccgacaattttgccgcctcttacattccgcgaagcaatagaatgtacaaagatatattcggtagcaaacagacttgacagcggaaaacttattacggaacgtccttttcgttctccgcatcatacaataagcagtgttgcactgtgcggcggaggaacaaaccgaaaaccgggagaattatctcttgcacattgcggtattctttttcttgatgaattccccgaattttctaaaagtgccatagacagtatgcgcgcgccaattgaagacggtaaaataacaatttcaagggcaaacggctccgtgacatatccttccaacataatgcttgtttgtgcgatgaatccctgcaaatgcggatatctcggacaccccacaaaaaaatgtacatgtacgccgacacaaatcaataaatacatttctcgcatatcgggtcccatgcttgatagaatcgatatacatattgacgttcctgcagtcgagtataaagacataagctca

SEQ ID NO: 2504 - DNA, 1503 bp, Unknown
  Description of Unknown: Clostridiales sequence
ggcagcataaacagccagatggcaaaggaggttcctgtttttatacttgctccgggaacctataccgaaacaaggctcaccgtacgctataacgcggtgattttaggcgcaaacgcaggcatttcgccaaatgccgacatcgatctgtcaacggctaatcccaaaacgggctggaataaaaataccctacgtggcagcgaaaccgtgatttcaaacggtttttcccgttcgacacaggtaaacagctctctgacaaatcaaaaatacgagcaggccgcctcaaacgaaaccgaattttcgcttataatcgacggagtcaaattttcggctgcgtctaattttctaacgcttgccgacacaacaggtgcaaaaaaacgtacaatgtcagtgactgtgcaaaacaacgacattgtcactacaaacgcctctttttatatagatgactctcagtcggcaaacaacgtaaactgctacgattttaaaaacatacgcagtgacggcaccaaggtaaaaagctttttcggtgcaaacgcctcgcacgttcgactggacggggtatattttgccaacagctccggctccatttcacaaagccagcttatcgctccgtatgaattttcttttcttatgcagaattcgtatatgtacaaatgctcggctggctacaatcttaatttcagatataaagattcagagcataaaagcaaggtcacgctaaacggcaacctgttttacgagcataacagcggaagctatggtgcgcttacattttacagcacaaaatctcacaaggactcaagctacgagataaacatacaaaacaatatctttattgccgaccaaagctataataccacagcgaaaaacacttttctgaacggcaacacaagctatcagcagggcgcatacgccatgtatgtcaaccgcaacagggttattggctacacaagccttttccccaacatgcccgacaatgtaacatacataacagcggactttaactataactattttgcgccgtcatataacagtcatgccgacgtattgggaactacaagccagtactttagtacaacgccctattccgaccctattgacattgacaaccttgtatattatgaagactttgccatgaccgtctatgacggcatgctggacgtatccggcgtcagcttttatgaggatgcggactatgtaagcattgacaacgataattcgcttatcacggcgtcatacacctgtggcacaaatatccaaaacccagcgctgtattttcgagacagtgcagtaaccgcagaatttttttctgacagcagctgtgcttcccgcataacatcaatttcagcaccggctcaaaacgctgtcacaacggtctatgcaaaagccgttaagggctccgcctcaaaagtgattactgtaaagctttacggtgaaaatgctgttgatgactttgcaagcggttggtctgacccagagggtactatacaaaatacggcgtatctt

SEQ ID NO: 2505 - DNA, 984 bp, Unknown
  Description of Unknown: Clostridiales sequence
tcgctggatgatatcatgtatgcgatagcgatttccagtgcaaacgaggctgcaaatgcgctggcgtcccatcttttcggttcggtgcctgactttgtggcaaagatgaatgaaaaagcagcgcagcttggtgccgaaaacacgcattttgccaatactcacggtctgcaaaatgaggaacactataccacagcccgcgatatggcgagtattgcaaaggcggcttttgaaaatgaaacagtgcttaaatatctgtctacctctgttcacgagatagctccgaccaataaaactcccgaaaagcgtactctcgttacgacaaattcattgatgcgcaaaaacagcgagcattattataaatattgccgtgcaggaaaaaccggaactaccacgcccgccggttataaccttgtgtctgttgcgcaaaagggcgacattgagtttttgctggtggcgatgcacgtggataagcagactcacccaaccaacactgtattttccgattcgcgcagtctttacaactgggcgtttgataactataaaagcgtaaaaatccttgaaaatactgaaattgttaccgaggtgaaggttgagctttccgccaagggagatcatcttatcctcgtacccgaggaaaatgtttattcggtcattcccgtcgaccttgatgtttcgacgataaatcgagatgttaaaaccaatgagaagatttttgcccccgttaccgagggcgatgtgcttggcagcgtcactctttcaaaagacggagtgacctatgctaccgtaaatcttgtagcgggcagcagtgtggaacgctctaccgttttgtactatctgcatcttatcgagcagttcttttcaaacctttgggtgcgcattgtgtgtatcattctcggaattattgttgtaatttatataattattatgatatctcagaacaagcgtcgccgacgcaaaaagctgcgccggcggataagattttaa

SEQ ID NO: 2506 - DNA, 621 bp, Unknown
  Description of Unknown: Clostridiales sequence
atcaaagagtgctaccgtgagatagtaaaagactttgcccaactgcccagacgcgatgagaagcctgtacgggttggaattgtcggcgaaatatacgtgaaattttcaagtttaggcaacaacggattagagcagtttttagtagatgagggcgcacaggtctgtgtaccgggatttcttgatttctgcttttactgcatctataacagcataatggacaaaaagctgtataacagaatacgcttgccgctgtttatctataaatttgcgttcaattttgcaaagaaaaagcagcgtgatatgatagacgcagtagttcaaaacagcagctttgaaccgatgacgccgattgagcatacaatttcgctctgccaaggctatataaacctcggagtcaaaatgggcgaagggtggctgctaacagcggaaatgctggagttgtacgactcgggcaccaaaaatataatatgcacacagccgtttggctgcctgcccaatcacatctgcggcaagggcatgatgcgtcctttaaaggaacaaaagccggatataaacatcgtcgccgtagactacgacgcgggtgcgacgaaagtcaatcagataaaccgcataaagctaatg

SEQ ID NO: 2507 - DNA, 930 bp, Unknown
  Description of Unknown: Clostridiales sequence
cttttggcggcagtcggtttagggcttttggtgttttatattgtgcgtgtaataatcggaatagtgaagaaccctgaatcgattaagcacagactttataagctttttatcaatgcgctgtgtgctgtgtccgtcgcactgtttgcgttccagatctgtatgggtcttaattattatcgttttgaggcgtctcattatctcggtctttctgtgcgcgagagctcggtggaggagctgtacgagcttacaaagtcgcttgcggatgatataaactattatcgtgaaaggcttgaggaggatgaaaatggagtcagtgtgctttcggacaaaaacaggtatgagacctcaaagagcgcgcgtgaagcataccgcagtctgtcggataaatattcctttctgaaagcggcagacatacgaaacaagcctcttgtcacgtcaaagctgttttcggctgtaatgacgactgggatttatattccgtacacttttgagtccaatataaatgtggatgtgccggagttttctattccggctacaatgtgccatgagctgacgcattttcgcggatttatgcgggagaatgaagccaactttttaggatatcttgcctgtatggagtcgccgcgggacgattttaagtacagcggcgccatgatggcgttttcatactgctatcctcagttgtccaaggcggataaggagcttgcttctttagttgctcagaatgtgtcggacggcgttatgcgggaccttgtatttgaggatgaatactgggagccgtatcgtaagacggtaacggcagatatttcaaataaggtgtatgacagctacttaaatgccaataatcagcaaagcggcatgaaaagctacggcgaaatggtggatttgctgctcgcttacagacgcacgctcggtgctgaaaataaatga

SEQ ID NO: 2508 - DNA, 549 bp, Unknown
  Description of Unknown: Clostridiales sequence
atggattttaaaggaaaagtcatgaataaaaacggcgccgcacttgcgggagttaaggtgagtaacggcagacatatctgcctaacggacagcgccggcgaattttgtctgccgtactgggaaaggtcatctgccgtttttgtaatgcttctcacaaacggtcaggatgactggtatatacttacagagaaccgcagggaagattacatattttatatagacgcggcaaaaacatccgcggaaaacttctgttttctgcatatgtccgatacggaaatcgaaaacaaacggtgtatatttatgcctgccgtgcagaaggctgtcaccgaaaacaagcccgcctttttaataaacacaggcgatctgtgccgtgccgacggtgtaaagtatcatataaggcagatgaacagccgcattgcgggctgccccgtgcgctacactattggaaatcatgattttctcgaaggtccttacggtgaatactcctatgaacggctgtacggaccgctgtggtattccttcgattgcggaaacattcattttgtggcg

SEQ ID NO: 2509 - DNA, 537 bp, Unknown
  Description of Unknown: Clostridiales sequence
ggcggcaaaaataatatcggcaagacagataatacgattataagtgtatatgacgcgctgaaggaaaatcttgctgaacgcggcaaggagggatatttgctttacggtgcaaagctgcttgtaaacagcgaaaatgtcggcaactacacttatgtgtataccgataagcgtcctgatgatatgaaatattccgatatacttattgtagaggttaataaccgcactggacgtattgaaaagtgttctgcgcccgattatgcggattacggtgcaatgccgtatgagcttataagccacgcaatgccgcttgaaccggatacttttgaggcggattcagatactgccgtcaaaaatgcagcgcttgcgcatcagggcagcggatttgtgtataattatgttgaactgactctttgctataaaaacggtatgccactttacgaaatagaccatatctcgcttgttaacagctgcgtttatcacagtgttgtggacgttatgtcaggagaggttataaataaatcggtggaggaactgtaa

SEQ ID NO: 2510 - DNA, 2088 bp, Unknown
  Description of Unknown: Clostridiales sequence
cctatgaccggtgagataattgccgaggcaggagataaaattacaaaagaactggcttctaaaatcgaaaacgccggcgtgttcagcgtaaagctgaatataaacggcaatatcgttcccgtattttcaaacggcatggtcgaaatgaaacattttgtaaattttgacccgcatgagtgcggcgtcaatgagcgtgtgcgcttcaacgtgctgcgcgagatactcgacgcctgtgaaaatgacgagcagataaaggaacagtgtgctcttcgccataatgagcttattcccaaacatattataatagacgatatcatggcaaccgtgaactatgtgtttaacatgacctacggtgtcggaaattccgatgatatcgaccatctcggcaaccgccgaattcgttgtgtcggcgagcttttgcagaatcagttccgtatcggctttgccagaatggagcgcaccataaaagagcgcatgtcgcttcaggatcttgacgttgtaactcctcaggctcttataaatgtgcgtcccgtagttgcggctattaaggaatttttcggttcttctccgttgtctcagtttatggatcagaacaatcctcttgccgagcttactcataaacgccgtctttctgctctcggccccggaggtctgtcaagagaccgtgcgggctttgaggttcgtgacgttcactatacgcattacggcagaatgtgtccgattgaaacacctgaaggtcctaatatcggtcttatttcctatcttgcatcgtttgcacgcataaacgagtatggctttattgaagcgccgtacagaaaaatagataaagagaccggcgttgtcacaaacgaaatagtttatatgacagctgatatagaagatgaatttaccgtggcccaggccaacgaaccgcttgatgaaaacggaagatttgtaaacgatatggtaaccgcgcgccgccgagacgagattatcgagatagaaaaagataaaatcgactatatggacgtatcgccgaagatgatggtatcagttgcgaccgcgtttataccgttccttgaaaacgacgatgccaaccgtgcgcttatgggcgcgaacatgcagcgtcaggctgttccgcttcttaaaaccgaggccccgattgtaggcacgggtatggaatacaagtcggctcatgactgcggctgctgtatagttgcaaatcgtgccggagtagtagaatatgtaagcgctgataagatagttgtcaaaggtgatgacggtgagcgtgatgagtacagccttattacgttccttcgttctaatcagggaacctgcatcaatcagaaacctatagttgaagttggcgagcatattgaggcagacgaaattattgctgacggtccttccactgccaatggagaaatagcgcttggtaaaaatatgcttataggttttctcacctgggagggttataactatgaggacgccgtgcttctcaatgaaaagcttgtaaaggaagatacttttacatctattcatattgaggaatatgagattgaggcaagaagtacaaagctcggtccggaggaaatcacccgcgaaatccccaatgtcggagatgacgcgctcaaggaccttgatgcacgcggtattatccgtatcggtgctgaagtttcaagcggcgatattcttgtcggccgcgtgactcccaagggagagacggagcttaccgctgaggaaaagctgctgcgcgcgattttcggagaaaaggcaagggaggttagagacacctcgctgcgtgttccgcacggtgaatacggcacaattattgatattaaggtgtttactcctgaaaactccgaggaactgtcacccggtgttaataaggttgtaagatgctatatagcgcagaagagaaaaatttcggtcggcgataagatggcgggccgccacggcaataagggcgttgtgtccagaattttgccgcaggaggatatgccgtaccttcctgacggtacaccgcttgacatagttctgaatcctttgggcgttccgtcccgaatgaatataggtcaggttcttgaggtacacctcggtcgcgctgca

SEQ ID NO: 2511 - DNA, 636 bp, Unknown
  Description of Unknown: Clostridiales sequence
cgaacggatgagacctatgaggagggcagtgccgagttttttgaaagttatcttgcaaactttatcatgcaggacatgcccgactttgaagatccgcttgaccttaacgaccagtacataatttctttcggtatctggcaggctataacgcttaataactatcagggcgtgtatacatataattcaaacggcagctttaggatacctgtaaaggatgttgaaatgtatgcaagctactgtcttgacttcccacgcaagattgaccaccgttcagttgatatctgcggcagcttcaagtataatatactgaacaagacgtataccgttccagcggcaaacattgattcttatttgattcccgatatattgaacgttgagaaaggtgaaaacgatatatatatcatcactgccgactgctatgagggcaatctcgtgtcatccgagatacctgaaaatgatcctgcaaacttccgccgtcgcgttgttatcacattgcaggacatgggtatccaaagctataatgcggagactggaacgcctgtgccgcggtatatgattctgtcttcaaaaacagtggacgaaaccgcggatcttgataatgacggagttgtggacgacagtcagcaggaaaacgat

SEQ ID NO: 2512 - DNA, 774 bp, Unknown
  Description of Unknown: Clostridiales sequence
atggtttattcagagctcggggttgaaaacaagggtatctttgactattacggcgatgaggattattttattcttccgcctgacgtaacggataatatcaataaatcggtagttcgctttaccaaggcggattttgatataaacgtagtaatatacgataaggaaaggaacgttataggtcagtatgtctatattccgggagagaccgaggcgatttcaatgtacggccttgaaaatgcctacgccgtatcgctgtattcgtacaacggtgaggcgagcggaacggagtattcttttctgtttgaacataccgatattacagtgctggacatcgagacttacggctttgcgctgacgcctgaattctcagaagaaaacgattattacaccgcgacagtttcctctttggaggaaaaaaagataacggatgttatgcactcggcaaagaacgcaagcattacaattaaggttaagcagcagtccggctttgaaacagaggcaaatctcggcgacaatttaaaccttgctccgggtagaaatactgtgacgctaacggttgaggctaacggaataaagcatgagattgttattgttatttccgacaagacatacgatctgtcttacggatatatcacagctcaatccgcaactgtatatgaaaaggcgacaagcggttcaaagaaaattacaactctgggcaaaggcacaagtgtgcttattgtcggcgaagatacagatgcttcctttattcatgttcagctttgcagcggcgaa

SEQ ID NO: 2513 - DNA, 1629 bp, Unknown
  Description of Unknown: Clostridiales sequence
gagtcagattattttgaaattcatccgcaggacgcagttcttcctttagagcctggagtaatacgcgacagtaagctttacggtgcgctcggttatataaacgccatacgcgcaggtgccggcttacctctgctcgaattgtccgaggagctttccaaaggatgccagtataaggcgattttaacttcatatatcgggaaaaacggtatttccaatcctaacccgcattatccgcctcagccggacggagtctcggatgagtattatgcaattgcgcagaacggcgcgggtgaaaacctttatcacggtacggttatcacaagcattaccaatgctcttaatgacgcatacggagatccgataacctgcggtcacagatataatctgcttaatccaacatggaaatatatcggcttcggaagcacggaagttgataaccatctttcgatcggtattcagggtgttcacaaaatgagtggatatcaggaaagtgacgctgaaatcgtcgcatggccgtcaaagggcgtgatgttagaggaggcgggagcaggaagcaatacgatgtatactgcttcttttaataaaacttatggattcaccaaagataccggagttatttttaaatgtctcaatacaggagaaacatttgaattcataccgggtgaaaacaaacagaatcatgaacttcataacagcgggtcaattatctcatattatgacgccaatatatccatgacggtaggcaatgtatatgagataaccctgaccaatgtaaaaaaccacggtacaggagaaataattgattatacatatcgcagcgtgtatgaatccgcttatggttcggactcctcagatactgccacagatatttctatgtcaagcagcagtttaacaatggcagtaaaccagcgtgtgaaaataaacgcctccgttgttcccgataactgtaaaaataaaatgattttatggtcctccgataacaatgaaattgctacggtaaatgaaaacggttatgttacagcgcataaaacaggtactgtcacaatcagcgcttctactgataacggcgtagtaaaatactgcaccgtaaatatacaggcaactccgtttaccgatcttacctcaaaatggtatataccgtttgttgaaaaagcatatcagtgtggaataatgagcggtatgactccgactacgtttgaaccggcaaccagcatgagccgggcaatgtttgtcaaagttattgcaaatctcgaaggtttggatcttgataacactgtaccgacagttttttcagatgttcaggtcggcagatactttacgggaccgataggctgggcaagtcagaacggtattgtaaacggaatttctcctaccgaatttgctccgaattctcctattacccgcgagcagatgtgtgctatgattgtcagatatgccgaatataagaacattgcatttgatcagagtatatcccccgtaacatttgcagatgaggataaaatttcaaagtatgccaaagagtatgtaaaaatttgccagcgtgcaggatttattgacggcatgactccaacgacctttgaaccgaaaggtaatgcaacacgcgctcaggtagcaaaaatattttctatt

SEQ ID NO: 2514 - DNA, 750 bp, Unknown
  Description of Unknown: Clostridiales sequence
atacttgaaaatttaacatctcccgatgatttgaaaagcatgtcctcagacaatttgaaaattctttcggatgaactgcgtgaagcgcttattctgaatgtttcaaatacaggaggacatctggcgagcaatctgggtgttgtcgagcttactattgccatacacaaagtcttttcctcgccggcggatcaaattatttttgatgtggggcatcagtgttatgtacacaaaatgttgacaggacgatataaccgtttcagcacgctcagacaaaaagacggcctgtcaggattccccaatccggaggaaagcgagcacgatatatttaaaaccggccatagctctacatccatttcatctgcgctcggccttgtttatgcaaaaagtgtgtcaggtgatgacaattcttctgtcgtcgctgtaatcggtgacggctcaatgacaggaggacttgcgtacgaggggcttaacaatgcaggaagctcggaaaaaaaccttgtcgtcatcctgaatgacaataaaatgagcatttcaaaaaatgtcggtgctatttcaaagacgctgacgcggctgcgaagcaaaagcggatattttcggtttaaagatgcgctcggcagcgcgcttgtaaaaattccgtatataggaaagccagtttatcgacgacttaatcgtttaaagtctgcaatcaaatcttatttttattcgtcaaatatttttgaaagcatgggatttaaatatataggccctatc

SEQ ID NO: 2515 - DNA, 1242 bp, Unknown
  Description of Unknown: Clostridiales sequence
atgatgctttgtgcaagatgcaataaacgtatggcggttgtatttgtctcaaaatatgaagataataaaaccgttaatgagggttactgcctgaaatgtgctaaagagcttggtatacatcaggttgatcagattattaagaatatgggtatttcggatgaagatatagatactatgtctgaggagtttgattcaatggttgatcagatgggaatttctcctgatgaaatggattctcaaactgcgccttcgtttcctccgtttttcggtaatttcatgaataacattgtgtcatccggcaagcagccggatacggaacgcagtgcggagaagaccgataataaaaaggatgagaaaaagcaaaaacgtactgacaaaaagagaaaatatcttgaccagtacggagtaaatctaacaagaaatgctcacgatgggaagcttgaccctgtgatagggcgtgacgtagagcttaccaggttaattcgcatactgaatagacgcacaaaaaacaatcccgtgttaatcggtgagccgggtgtcggtaagactgccattgcagaggcacttgcgcaaaaaattgccgatgaacaggttccggcaaagctgcttgataaggaggtttatcttcttgatctgacggcgcttgtcgccggcacgcagtttcgtggtcagttcgaagccagaattaagggactgatatcggaggttgtggcgcttggtaatattatactcgtcatcgatgaggttcataatcttgtgggaacgggtgacagtgaaggaacaatgaatgcggctaatattttgaagccggcattgtcccgcggtgaaattcaggttataggcgcaactactctttcagagtacagaaaatatatagaaaaagacgcggcgcttgagcgcagatttcagccggtcatggttgacgagcctactataaacgatactattgaaattctcaagggaatacgtcccaaatatgagcagtatcataatgttagaattcccgatgctttgctcgcacaggctgcgctgatgtccgaaaggtatataacagacagatttttgccggataaagctattgaccttatagatgaggcgtgcagcggtgcggcccttgaaaatgtggcgcaaaattccattgttaagaatacgcgcgcgctgacgcagatcaagcaacagcttgaagagctcacgggggccgaacagaatgaagagacatataaaaaaatcgcagaactgcgc

SEQ ID NO: 2516 - DNA, 672 bp, Unknown
  Description of Unknown: Clostridiales sequence
gtgctcataggtcttatcatgttcggctcggtttcacttatttataattctttttctatttcggtaagtgagcgtacaaagcagttcggaatactcaaatcgataggcgcgacaaaaaagcagatacgccgcacggttttttatgaagcactttttctgtgtattattgcggttccgctgggaattatcgcgggttgtgcggggcttggaattacgctgtatctgctgcgcggagcattcagctcggctgagatgttttttaataccggtgcggggctggctcccaagcttataatttcgccgacagcgcttataatagcagcggctataggtgtcgtaacgactgttatttcggcgtatgtgcctgcacgccgtgcagtaaaggtgccgcccattgaggcggtgcgtcgctcaaatgacattacggcaaagcaggttaaaattcacggaaacggaatagtttataagctgtttgggtttgagggaatgattgccgccaaaaatttcaggcgcaataagaaacagtaccgcacggcgatactgtcgctgtttatgagcgttgttctgtttgtttccgcgtcttccttctgccggtatcttacagacgctgcgggagatgttgacagaagcgccggatatgatatatcctacgttatgcatgatgcttacgat

SEQ ID NO: 2517 - DNA, 1575 bp, Unknown
  Description of Unknown: Clostridiales sequence
gttgtgcagcatatggagccggatcattctgcaaatattttgaattttacccgtgcctaccccgatgcggaaattgttgcaaatgctaaaacttttgcaatgatggatcgttttttcagctttgagcgtgttgataaccgcattgttgttgaagacggtcagatactcacaaccggaaggcacagctttacattcgtctttgcacctatggtacattggcctgaggttatggttacctatgattctgccgataaggtgctgttttccgccgatgggttcggtaaattcggtgctctagatgcggacgaggactgggcgtgtgaggcaaggcgctattacttcggtattgtcggcaaatacggagctcaggttcagtcattgctaaaaaaggcggccggacttgatatttctgtaatctgtccgcttcacgggcctgttctaacggagaatttaggctattatcttgacctttataatacatggtcatcatatcagcctgagacagacggtataatgattgcatatacctctgtttacggtaatactaaaaaggcggttgagctgcttgccgaaaagctgcgtactctcggctgtccgaaagtggtagtgactgaccttgcgcgctgcgatatggcggaggcggtagaggacgcattcagatacagcaagcttgtgcttgcgacaacgacctataacgcggatatttttccgcccatgcgtgaatttctgagtgatcttacagagcgtaattttcaaaaccgtacggtggctcttattgaaaacggctcgtgggcgccgatggctgctaaaattatgcgcaaaagacttgaaaagtctaaaaaaatcgattttgcagagccggttgtaactattaattcggcagtgaaagatgatgctgtcgctcagctggacaagctgtcgcatgagctttgccgtgattatatcgcacgttcttccgatacggcggataaaaacgatttaacggcgctttttaatatagggtacggactttatgttgtcacttcaaacgacggtaagagagacaacggacttatagttaataccataacgcaggtgacaaatacgcctaatcgtattgccgttaccatcaataaggataattattcacatcatgttatcaaacagacaggtattatgaatgtgaactgtttgtctgttgacgcgccgttttccgtatttgagcggtttggattccaaagcggtagaaatacggataagtttgcgggttttgacttcggtcgatctgataacggacttgcgtttttgaatttgtacattaattcgtttatgtctttaaagacagttgactatgtcgatcttggtacgcacggaatgtttatttgtgagataacagaagcgcgtgtcatgaatgaccgtgagactatgacatatacttattatcagaaaaatgtcaagcccaagcctcagacagagggtgtcaagggttatgtctgcaaggtgtgcggttatgtctatgaaggtgaaaccctgccggatgattttgtttgtcctctgtgtaagcacggtgcgtccgactttgaaaagatagtatag

SEQ ID NO: 2518 - DNA, 1152 bp, Unknown
  Description of Unknown: Clostridiales sequence
atggcacgcaataaatttgatattgacgaagagcttgaaactccatttaatatagccaatttcaaacggtgtaaaaaatacatcaaaaacagcgcctcaatgctgattatcggtgccgtactcagcttgcttgctacggtattcgctctgtgcgggccatattttgttaagatggtaattgacaatatcgaaaaacagcaggcggcaggtacggccgaaatttcgcccattattttgatttgcggactgtatgttctttgcgttctgctcagcgaggcgtgcacctatttcagaacgattgtcacttcaaaggcgggtcagcagataatacatgaaatccgcgttgatattttttctcatatacagaagctgtcgtttaactattttgacagccgccctcgcggcaagatactcgtgcgtgtcgtgcattatgtaaataatgtcgccgactttttgtccaacggacttattaatatagtggtgcagtttctgactgtattcattattatattctttatgctgtcgcttgacgtgaagctatcgcttattgttttgtccggtctgcctatatttattatatatatggtgcttatccgcgggcgtcagcgcagagcgtggactgaccattcggcgaaaaattcaaatgcaaccgcatatgtcagtgaatcgataaacggtatgcagataactcaggcatttaaccgtgaggagataaaccagggtatttatgatacgctgctcgagaaaatgcgcaaatcctttcttaaagcggctactattaataacagcataccgtttattatagagaatctctccaactttgtcagggcgtttttgtatgttgccgctattgtgctgtttgtaaacgatcagtattcggcgggtaccattgttgctatgggctcttatgcctcccgtttctgggggcctatccagagcatcggtgatatttataatcagcttatcaataccggttcctatcttgaacgaatttttgacacaatcgacgaaaaagtggaaattgaggatgtacccggagcgtatgaacttcctgcaatccgcggcgaggttgagtacgacaatgtgacctttgcgtatgagcaggggcacaatatccttgaaaatgtgagctttaaggttaagccgggacag

SEQ ID NO: 2519 - DNA, 2073 bp, Unknown
  Description of Unknown: Clostridiales sequence
ggagaagtcatgtcgtatacattttggaatataaaaacacaggatataaattgcgtaaatgcactgtcaaatgcgcttgactgcagtgatattgtatctcgccttttaattaaccgtaatatagtcacaaaagagcaggcgcagcgttttctctatcctgatagcagcgtggattataatccgtttttacttgaggatatggacaaggcggtagaacgtattgaaagtgcttttataaataatgaaaaaatatgtatatacggtgattacgatgtcgacggcataacgtcggtcagtgttttgtatctatatcttaagaattttacctctaacattgaatattatattccggacagatttactcagggttacggtatgaatgatgatgccgtaaatcaaatagcttcgcgcgggtgcaaattgataattaccgttgacacaggaatttcggcgttcggtgaagctgtgactgcaaaatcgcttggcattgatatgattataacggatcatcatgagtgccagggtcagatgccacaggcttttgctatcgttaatcctaagcgcacggataatgtatatccatttcggtatcttgccggggtaggcgttgtgtataaactgatttcagcgctggatatacatatgaatacctgccaccgcgatgataatattgaccttgtagccgtcgggacaattgctgatataatgccgcttcttgatgaaaacaggcgtattgtcaagaccggacttgaaaaaatgtcgtcttctccgaatatcgggttgaaaatgttgaataagatgtgtctatcatctcaaaacataacctctggaaatgtcggatttgctattgcaccgagaattaatgcggcaggtcgcatggaaaatgcccagactgccgttcggctttttgtaactgagagcgacagcgaagcaggcagtgttgccgagcatttatgtgaacttaatgcgcttcgccaacagattgaaaataaaatttatactgaggcaatagagattattgaaaatcatcagcttgacagcaggtacagtgtgcttgtactttggaaagagggctggcataacggtgttattggaatcgtggcctcaaagcttaaagataaatataataaaccggttgttttgttttcggttgatgtaaattcaaaaggctcagcaagaagtgttgcaccctttaatatattcgaagcgtttggaagtttagaggatattctcattcagtacggtggtcataaatatgcggcgggtgcgctcattgaaagcagtaagctctatgagttcagggatagactgtgcaattattttgacagttgtgaagaaagcaatattgcatcaaataaaattgatatagagtgtgaactgacggaaaaaatgcttaccgttaaaacggtttccggtgtttctcttcttcagccatttggcaaattaaacgaagtgccgcttttttgcatcagaaatattataatttccggtgtatttcctacctccagcagccgtcatttaagactgaaatttaatataggtgacaaaattattacaggcttttttttcggggtgaatttattggatttcgattaccgcgaaggagaccttgtagatattgtttgtgaactcggcgaaaacgaatacagaagtataaagagtgttcagcttgttgtgcgtgatttgaggcttagtgaaaatcagcttgagaattatcgtagcaagcgtacgttttgcgatacatcggatgatattttgccgtctatgttgccttctcgctcagatattgcggtagtttataaatatcttttgaaatgtttttcaaatggaaaaagaaaatttaatattgataatattgcaagcattatttgtaaggatagtcttgtaaaactcaattatgaaaaagtctatttttctgttaagatattgtctgatcttgaaatagttgtttccgatatcgaagataatgttcttaaagtatcggaaatatttgatgagaaaaaggtatcgctttacgattctgcgcttctaatgagtgtttacgaaaaggcgggtgttaaatttggaaattga

SEQ ID NO: 2520 - DNA, 1041 bp, Unknown
  Description of Unknown: Clostridiales sequence
atgtacgacagaatttacaatttttcggctggtccttccatgctgcccgtgcccgttttggaaaaggcgcgcgatgagatgcttaattacggcggttccggcatgtcggttatggagatgagccaccgctcgaaattttttgacgacattatcgttgaagctgaagagctgatgcgcgaagtcatgaatatcccggataattataaggtgctgtttttgcagggaggcgcctcgctgcagtttgcaagcgttgttatgaaccttatgaaaaccggcaagatggattatgttgtcacgggtcagttctccggaaaggcttataaagaaggccagaaatacggcgacgcgcatcttgcggcaaccactaaggatgaaaactttacacgtattccacgtcagaatgagcttgatttgcgtcctgacgctgattttgtacatatctgctttaacaataccattttcggtaccaagtgggattatatcccggagacaaacggcgttccgctggtcgccgatatgagctcctgcatactgtctgagccggttgatgtttcaaagtttgcacttatttatgccggtgcgcagaaaaatgtcgcgcctgccggtcttacaatagtaatagtaagagaggatatgctgcgcgatgacctgcctgattttgttcctaccgtatgcagctacaaggtgatggcggaaaacgggtctatgtacaataccccgccctgctatcctatttatatctgcaagcttgttcttgagtggataaagggtcttggcggccttgaggcgatgaaggaaatcaacaagagaaaagccgacaagctgtacgcatgccttgaaaagagcaagctgtttaacaatcctgtcgttaaggagtgccgttctatgatgaatgttaccttccgtgccgagagcgatgacatgaatgcaaagtttgtaaaagagagcgcggcggcaggctttcagaatcttaagggtcaccgttctgtcggcggcatgcgcgcttccatttacaatgcgatgcctgaagagggcgttgac

SEQ ID NO: 2521 - DNA, 927 bp, Unknown
  Description of Unknown: Clostridiales sequence
tctgaactttcaggtatgctcaggtttcttgcaagcggcgctgtcaagggcatgggacctgctaccgcgcaaaagatagtggacacgtttaaagaggacagcttttatataatagaaaatgaacccgacaggctgactcagattcgaggtatttcccgggaaaaggcgcgcattatgtccgattcgtttcgcactactcttggtattcgtgatattatgatgcagctcaatgagtacagtatttcacccaatatggccgtcaggatttataaacgtttcggcggtttttccgttgatgtcataaaccgcgaaccgtacagactttgggaggaaatagaggattttacgtttgccgcggcggataagatagcgcttgaaaacggtttcgagcccgattgtgaaatgagggtatgctattttatccgttttgtcctgacacataaccttacaaacggtcattcatttctgccgtatgataagctatcgcagatatctgctgccaacatcggtattgaaacctctgatactgagtgctatatcgataaaatgatagcagagggcagactgtatgagcagaagataggcgatctgcgcgcggtttatctgcccgcaatgtattttgctgaaaaatatgtggtaaaaaagctgtataatatatcgaaatatgtcaaaaaagaaataacagatattgaaaagcacatagatgctcttgaaaaaatgctgaatattacatatgccgacaatcagcgcgcagctatacgcatgtcggtggaaaataaggtgatggtgctgacaggcggaccaggcaccggaaaaacaaccactttaaacggaattataaaactttatgaaaatttagggtttaatgtcacactatgcgcgcctacggggcgtgcagccaaacgcatgagcgacgtctgtaagagg

SEQ ID NO: 2522 - DNA, 564 bp, Unknown
  Description of Unknown: Clostridiales sequence
atgagaaaccttgtaataccagaaaactaccgtcccgtgctggacatttcggaaacacagcgcgcaatcaaaacagtaaaggatacctttgagcgcgtgctttcaaacgcgctcaatttagagcgtgtgacagcgcctgtaatagtgcgtgcaaacagcggtatcaacgacgatctgaacggtgttgaacgcaaagtacactttaccatgaaggagataggcggagaggcggaggttgtccagtcgcttgcaaaatggaagcgcatggcactgatgcgctacggatttaaagaaggcagcggactttacacagatatgagcgcgctgcgccgcgacgacgacgcggataacctgcactccatttacgtcgatcagtgggattgggagaaagttataaccgcaaacgaacgcacgcttgattttttgaagcaaacagtcatctctattgtccgtgccgtttgcgcgacgcatcttacggtaaaggcaagctaccccgagctcaaatttatgacctgtgagacgccgtttttcatcacctcccaggagctggaggacttgtacccg

SEQ ID NO: 2523 - DNA, 1512 bp, Unknown
  Description of Unknown: Clostridiales sequence
atggaatttacgggaactctgtacattattttcggtgcaaacataggcaccacctttaccgcatggattttgagccttgcgggaattgaaagcagcaacatgttggtgtctatgctcaagccggaaaatttcacgccgtttttggcgcttttaggcgtgattttaataatgtccgccaaaaagagcaggcggcgggacgcaggacgggtgctcatcgggtttgcggtactcatatatggcatgaagtttatgacaagcgctgtaagcccgctcgcagacacgccggaatttgcctcgctcatggtaaagtttgaaaatccgtttttaagcctcatcgcaggtatcgttattactgcgcttattcagtcgtcatccgcatcggtaggcattttgcaggcgttttcactgaccggcgccgtaacatggtctaccgctttgccgataatcatggggcaaaacataggcacctgcatcacagcgctgatatcctgtcttggcggcagcaaaaacgcaaagcgcgtagcagctgcacacacatccgtaaacgtaataggaacagcggtgtttttcacgctgtttgaaatactccggttaaccgccagaggttcatttttctcagaggcaataaatcctgtcggaattgcagcggcacatacagcgtttaatattttatctacgctgctcattctaccgttcaccaaaaagctcgaaaagctcatatgcaggattgtaaaggacggcgcacctaaaaaggacggaatacctgcgctggacgaacggctgtttatgtctccgtccattgccgtaagtgagtgtatgtcgaaaacgagagagatggcgcagctttcgcgggatacggtacttttatccctggagcagatatcaaagtatgacaaaaaggtatccgatatggtatcggataatgaaaaacgttccgacatgtacgaggatatgctgctgacaagccttgtacgcattgcggaaaaatcactgtcagattatgacagcgcaagtgtttcgcgaatgctgtacacggtgagcgaccttgagcgcatgtgcgaccacgcgctgcatataagccttgataccggcgagcttttggaaaaaacaaaaggatattcaaaggaggcgatgaaagagctatccgtgctgagcgcggcggtaaaagagataaccgagataacatcggccgcttttttaaataacgacccgctgcttgccgtaaataccgagccgctcgagcaggtcattgacaagcttacggcaaaaatgcacaagaaccatgtaaaacgtctgcaaagcggcgcatgcaccgtagagcaggggctgacctttgcaaatctgctgggcgaccttgaacgaatatccgatcactgttcaaacatctctgcggcagtaatagagttatcgcacggcagctttgagacacacagatatctgcatgacgtaaagcatgaaaatgcccagtttaacagtatttacgcgcagttcgacgaaaaatacagactataa

SEQ ID NO: 2524 - DNA, 912 bp, Unknown
  Description of Unknown: Clostridiales sequence
atgttttcggaaagcgacagggataacgaatatacaggcggatatcaaataactctttcagacggtaaaatagaaagtaactgtgatactcttcttgtttctgacagcactgtaactataaagagcgccggcacctatattataatcggcagtctttcggacggacagataacagttgatgcgggtgatacggataaggtacgtcttgtgctgaacggtgtagaaataacaaacgattctactgcacccatttatgttcgtcaggctgataaagtttttataactcttgcttttggcagtaaaaatacgctttctatgaaaggtcagtatcaggcaatagatgaaaacaatattgattccgttatattttcaaaggatgatcttacgataaacggtgagggtgagcttgcaatatcagcagagagcgggcacgggattgtgtccaaagacgagcttgcaatatgctcggcgattttgaatgttacggcgcagagtcacgcgattgctggcaaggacagcgttaaaatagcggattgtacgttaaacttaaaatcaggtaaagacggtattcatgcggaaaatgccgatgatgtatcacttgggtttgtgtatgtcgaggacggtgatttggatattgtaagtgatggtgacggaataagtgccgccgcagttgttcagatacaggacggcaatatcaatataaaaagtgctggaggttttgaaaatgcgcctgagaaacagaaagcagatgactttttcagaggcgctgaccgtatggcggaaaacttttacagtcagactgccgacactgtcagttctaaggggataaagagtgatacgggaattgtcatagacggcggaagttttataatagattccgcagacgatgcaatccattcaaacgggaatatt

SEQ ID NO: 2525 - DNA, 1353 bp, Unknown
  Description of Unknown: Clostridiales sequence
gaaataaccttttcttcttccggaagctataattcatccggagccggagctaatacaaagcttagtcttacatatacgacggtagacggcacaaaggttcttgatactgcaaccaacagcgccacaaacaggacggttgagtttatacgaaatgcaggcggaatgcgcgtcagttatatagaaagtctgaaagaaaacgctgcggttgagcgtacaaaatttacttataagccgttttcaaccgaagtgtcggacgagcttgccgattattatattgtaaaatatattttcaataaacagggtcagacggcatacgttacggacagcgaaggcaattcgaaaaaatatgaatacagcgaaaaacaggccagcaggaacaagcttagttttgaatccaatttacggcgtatacccggaaatctcttaaaaaacggtaatttccagaccaaaagcttaaaatactggtcttaccgaggtgcaagctatgacaacttaaagcagatggttcagctgtatgacggggagtatatttcccagcaggtatatatatctatgcagggatattatacattatctgccgtaatagataattacgacgcggatattgttatgcgtatagaaaacagtaacggcagattggtaaaacaactgaaagtcggtcccacggacggaccggaaaccaagcagctcaccgctaacttaacagcaggcacgtatgttgtgagaatacgctctgaatataagggctgttatataaagtgtgtgcagattacaagaggcacaacagcggaagagttcaatctgctcagcaacagtgattttaacgacggcgcaacaggatggaagaaaaccggatttgtggataccgacgatcttatcggcagttattgtgagcttgtgggagattacaggacaaagaaaatgctgtctcagacagtggatgttgacgatacagccgatacggtgtatgtcttcggcgcgatggtaacgtccgactgtctgcccaataaggacaacggcgacggaacggataccagtgtagcgattactttggaactggattacgggaacggagaaaaggattataagacagtattctgtgaacctaagaccgggactgagtttattaatctgttcggcacggtaaaaacaccgtataatgtagacaagctgacaatatatcttaaaaatctgtataattacggagtggcaaaatttgatgatgtctatatattccgtgactcggccggtatatattataactatgacaataacggcaatcttaattacaaacaaagtgaatccggtgctgcaagcaatgccgtttatgatgagaacggagatattataagc

SEQ ID NO: 2526 - DNA, 2319 bp, Unknown
  Description of Unknown: Firmicutes sequence
atgaaacacaccaagcagatccttgcgctgcttctggctgtcgttctctgcattggcctgcttgccggctgcgccaagactgagacgaagcccgagaccgataccagcgcggacacgaccactccggaaacccccgaaactccggacgccaccgagactccggccgcagaagccaacgctgacggtaccatcgtcatcgctgagaccggcttcgaaggcaagttcagcccgttcttcgcagcttccgctcccgaccaggacgcgcacgctctgacgcagatcgctctgctgggcgctgaccgccgcggcgagatggtcctcaacggcatcgaaggcgagacccgcgagtacaacggcaatgactacacctactatggcccggccgactgcgttgtcaccgagaacgaagacggcactgttacctatgccatcaccctgcgtgacgacatcaccttctccgacggcaccccgatgaccatcgacgacgtcatcttcaacatgtacgtctacatggacccgacctatgacggctccactacgttctactccgtgccgatcgtcggcatcgacgagtaccgcggcggtatggatccccgtgtcaacgtcatcctcgctgctggtcccgacggctacaccgccaacgacctctacaccgaggagcagtacaatgctttctgggctgcgttccagactgcgggtgaaaagttcgcacagtccattgcggactacgttatggaaaactacggcgcggaagacttcgcgactgccgttgccatgtggggctatgaagctaccgacgccgctgacctgtggaacaagatcgtcgagacctacggctacgacatctccgacgacggcatcaacaaggaagttgctaccacttccatctccgacttcctcgctgaggagctcggcgacagctgggctgactacaccatcggtgtcaagaccggcgaatccgctgaccatgtcgaaggcattgtcaagaccggcgactacagcatgaccctgaccacttccgagctgtccaccactgcgatctatcagctccagatggagattgcgccgctgcactactacggtgatgtgagcctgttcgactacgacaacaactccttcggcttcccgaagggcgacctcagcaagatccgcgaggtcaccggcgctccgatgggtgctggcccgtacatcttcaacaactactctgacggcgtgttctatgtcgacgccaacccgaactactatctgggcgctccgaagaacggccacctcagcctgaaggaaacccaggaagctgacaagatcaccggcgtgcagtccggcgctctcgacatctccgacccgtccttctccctcgaagttgtcagccagatcgctgatatcaacggcgccgaaggcgacgacggccccgtcatcaccacccgtctcatggactaccgcggctatggctacgtggctctggcagccggcaacgtcaaggtcggcgacgaccccgcttccgaggcttccagggacctgcgtaaggccatcatgaccgtcatctccgcttaccgcgacgaaggcatcaactcctactacggtgagaccgcttccgtcatcaactacccgatctccaacacgtcctgggctgctccgcaggtcaccgacgacggctatcagatcgcttactccaccgacgtggaaggcaatgcaatctacactgccgacatgtccaccgagagcaagtatgaagctgctctgaacgctgctctgggctacttcgaggctgccggctacaccgtcgaggacggcaaggtcacggctgctccggaaggcgccaagatggaatacgccgtcaacattggcgcttccggcaacggcgaccacccgaccttccagacgctgaccaacgctgctgcggctctcaagaccatcggcttcacgctgaccgtcaacgatatggccaacgcttccgacctgttcgcgtcctatcagtccggcgaggctgagggctgggttgctgcatggcagtccaccaacgacccggatatgtaccagctgtatcattccaacggctccaccaactactacgagatcaacgacgctgatctggacgagctgatcatcgctgcccgccagaccaccgatcaggaagcccgtaaggccatgtacaaggaagctatggaaatcatccttgactggggcgtcgagctgccggtctaccagcgctccaacgcgaccatcttctcctccgagcgtctggtcgtcgattccatccccaaggatatgaccccgtactggaccttcttggctgagatcgatcggatccaggtcaagtaa

SEQ ID NO: 2527 - DNA, 1383 bp, Unknown
  Description of Unknown: Firmicutes sequence
atggaaaagctctgggccggacgcacagaaaccgaaactgccaagctggcggacgcgttcaactcctccatcgccgtcgatggacggatgtacaaggaggatatcacaggctcgatggcgcacgccgccatgctggccaaatgcggcattctgacacaggcagacgccgatcagatcatcgacggtcttgccggcattctggccgatctgcagtccggcgcgctggcgctcgatccgcaggccgaggatatccacatgtttgtcgaatccgtcctgacccagcgcattggggatgtcggcaaaaagctccacaccgcgcgctcccgcaacgatcaggtcgcgctcgatatccgcatgtatctgaagggcgaatgtgaccgcctgcacgccctgctgctggatgtcattcagtctctgcatgcgcaggccgcgcagcacaaggacaccatcatgcccggctatacacatctgcagcgggcgcagcccatcacgttcggccagcagctgctggcgtatgccatgatgctcatgcgtgactacggccgtatttccgacgcatatgcccgcatggacgcctcgcccatcggctgctgcgcgctggctggtacgacttatccgaccgaccgcgtctgggaagcgcagaagctcggcttctcctctacctgtgaaaacagcctcgacggcgtctccgaccgcgatttctgcgtggagctgatgagcgcctgcgcgctcatcatgatgcacctgtcgcgcctgtccgaggagctgatcctctggtcgagctgggagttccagttcatcgagctggacgacggcttcacgaccggctcttccatcatgccgcagaaaaagaacccggacatggcagagctttgccgcggcaaaacgggccgcgtctacggtgatctgatggcgctgctcaccacgctcaagggcatcccgcttgcctacaacaaggacatgcaggaggataaggaagccgtattcgactgcgtcgacacgacgaagctctgcctgcagatcatggcgccgatgctcgccaccatgcgcgccaagccggaaaacatgctgaaagccgcgcagaagggctttatcaatgcaaccgaccttgccgactatctgaccaagaagggcgttccgttccgcagcgcctacaagctttctggtcagctcgtcgcctactgcatccagcatgacacggtgctggagcagctgccgctggaggtctatcagagccattccgacgtcttcaaagacgatctttacgacgagatctcgctgaaaacctgcgttgcccgccgcatttccgccggcggcacaggacccgcctcggtgcaggcgcagctggagttggtcgaagccttccttgcaaatcatcattaa

SEQ ID NO: 2528 - DNA, 1752 bp, Unknown
  Description of Unknown: Firmicutes sequence
atgtgtgaagcatgcaaaaagacattttatatcaccacgccgatctattatccgtcagataagctgcacatcggccacacctactgcaccgttgcgaccgacgccatggcgcgctacaagcgcctgcagggctacgacgtcatgttcctgaccggcacggacgagcatggccagaaaattgaggacaaggccagggccgcgggcgtcacgccgcagcagttcgtcgacaatattgtcgccgggccgaagggcattctcgatctgtggaagctcatgaacatctccaacgaccgctttatccgcacgacggacgattatcatgtggagtccattcagaagatcttccgcaagatgtatgaaaacggcgatatctataagggcgaatacaagggcaaatactgcaccccctgcgagagcttctggaccgagagtcagctgaaggacggcaaatgccccgactgcggcggcgaggtccacgacgcgtcggaggaagcgtatttcttccgtctttccaaatatgccgctcgtgtgcgcgagcttctgacgacgactgacttcctgcagccgaagtcccgcgtcaacgagatggtcaacaacttcatcgatccgggtctggaggatctgtgcgtctcccgcaccagcttcacctggggcgtgccggtcgactttgatccgggccacgtcgtctatgtctgggtcgacgccctgttcaactacaccacggcgctcggcttcatgaacgaaaaatatcacgattacgacaaatactggccggcagatgttcattttgtcggcaaggagatcgtccgcttccattcgatcatctggccggccatgctcatgagcatgggcatgccgcttcccaagcacgtctacggccacggctggcttgtcatggacggcggcaaaatgtccaagtccaagggcaacgtcgtcgatccgtatattctggcggaaaagttcggcgttgatgcgctgcgcttcttcctgctgcgcacgttcccgttcggttccgacggcaacttctccaacgagctgctgatcaacaccatcaatattgatcttgccaacgacctcggcaacctcgtctcccgcacgacggcgatggtcgagaagtattttggcggcacgctgcccgaggcgcgcgaggccggcgaagccgacgaggcgcttatttcgatgctctccggcctgcgtgagcgctatgaggcgcagatggagaaattccagttccagaacgcgctcgacgagatcttcaagtgcatccagcgcgccaacaagtatatcgacgagacaatgccgtggtccctcgccaaggacgaagccaaccgcgcgcggcttgcttccgtcatgtataacctgctcgagtccatccgcatctgcgctacgctcctgctgccgttcatcccggcctcgtgcgaaaagatcttcgcgcagatcggtgcaggcgccgacgtcgtcacatgggacgctgcgaacgtctggggcaagctcccgcagatcgtgaccgtccacaagggcgaggccatcttcccgcgcatcgacgcgcccaaggcgctggccgaactggaggagctggaggccgcgcagaagcgcgccctgctgcccgccgtcgaggtcgagccgcagctggacgaaaaggtcgatttcgacaccttctgcagatccgacctgcgcgccgtcaaggtcaagacctgtgagcgcgtcaagaagtccgacaagctcctgcgcttcacgctcgacgacggcacg

SEQ ID NO: 2529 - DNA, 1278 bp, Unknown
  Description of Unknown: Firmicutes sequence
atgagtattgcatatcaggatctgacccctgcacagcttcgcgaggagtacgcggctgtcaaggcgcagtttgatgcgctgaaggcaaaaaatctgaagctcaatatggcccgcggcaagcccggcaaggaacagctggatcttgtctccgatatcctgacagtcctttccaagcccgaggactgcgtctcggacggcattgacgcccgcaactacggcgagctgtccggtcttccggccgccaagaagttctgggccgagatcctcggctgcaagccggaggaatgcttcatcggcggcaacgcgtcgctgacgctcatgtacgatctggtctccaagggctatacccacggcctgcgccactcggaaaagccgtggtgcaagctcgacacggtcaagtggctctgccccgcgccgggctatgaccgccatttcaagatcaccgagtccttcggcttcgaactcatcaccatccccatgaccccgactggcccggatatggacaaggtcgaagcggccgtcaaggacccggctgtcaagggtatgtggtgcgtgccaaagtattcgaaccccgacggaatcgtctattcgggcgagaccatccgccgcatcgcggccatgaagcccgctgcgcccgattttgcgctgatgtgggacaatgcctactgcatccacgagtttgacggcgatttcgtgccgttcgacgatatcctgacgctctgccgcgaggcaggcaacccggatatggtctatgagtttgcctccacgtccaaggtcacgctgcccggcgctggcgtctccgtcatggtcacgagcgaggacaatcaggcgtatttgcagaagctcatcggcatccagaccatctcctatgacaaggtcaacgccctgcgccacgtgcgctatctcaaggataaggcgcacacgctggagctcatgaagaagcacgcggcgatcctgaacccgaagttccagtgcgtcctgcgtcatctggacacgaccatcgcgccgctcggcatcgcgtcgtggcagcggccgaagggcggctatttcgtctcggtcaatacggcccccggtcttgcaaagcgcacactggcactgtgcaaggaggcgggtgtggtcatgaccggcgcgggcgcgacgttcccgtacggccgcgatccgcaggattccaacatccgtatcgctccgtccctgccgcccgtcgaggagctggagcaggcgatggacattttctgcaccagcctgcgtctggccgcgctggagcagaagctgcagtaa

SEQ ID NO: 2530 - DNA, 2127 bp, Unknown
  Description of Unknown: Firmicutes sequence
atgagtgactataaacccctgacctgcctgccggtgctcgcgctgcgcgggctggtcgtgttcccgggctgcgtgacgcactttgacgtgggccggagcaaatctgcccgcgctgtggaagaggccatgcgcgccgaccagatgatcttcctcatcgcccagcgcgacgtgcagtgcgacaagccgaaaaaggccgacctctattccatcggcactgtcgcctatgtccgtcaggtcctgcgcctgccgggcgacaatatgcgcattctcgttgagggcagataccgcgcgcagctgaccgaccttatccacgccgagccgtatttctttgcccgcgcgatggagctggacgagccgggctacaacgcggcgctgccgcgcacacaggcgctggtgcggcaggcgcaccagctgtttgagcagttcattgatcttgccgtcaaatccgggcaggagaatctgctgcagggttccgcgtcggatgaggcgggccatcttgccgatttcatcgcgcagaacgcgacgttcggctatgagcagaagcagaagatcctcgagacgctcccgccggtgcagcggctgcttctgtgcgtgcacgccatggccaaggagctggagatcctgcgcctggagggcgagatcagcgatcaggtgcagcagaacgtcaaccagaaccagcgcgactattacctgcgcgagcagatgcacgtgatccgcgaggagctgggcgaggacgacgactccgacgccgacagctaccgcgaaaaaattcaggccctgaagctgccagaggataccgaggaaaagctcctgcgcgaggtctcgcgcttcgcgcgccagcagtccggctccgccgaagcggccgtcctgcgcaactatctcgacaccattctcgagctgccgtggaacaaagagaccaaagagcggctggacgtccgggccgccgcgaagatcctcgacgaggatcattttggccttgagaccgtcaaaaagcgcattctcgagacgctggccgtgcgccagctggcgccggagcttccggggcagattctgtgtctggttggccctccgggcgttggcaagacctcggtcgcgatctccatcgcgcgcgcgctcaaccgcaagctggcgcggctttcgctcggcggtgtgcgcgatgaagcggagatccgcggccaccgtaagacctatatcggcgccatgcccggccgcatcatgacggcgcttattcaggccaagagcaaaaacgccctcctgctgctcgacgagatcgacaagctcggcagcgactataagggcgacccctcgtcggccctgctggaggtgctggattccgcgcaaaattccaccttccgtgaccactatatcgaggtgccgttcgatctctcccactgcatgttcatcacgacggccaacacgacggacaccatcccgcgggcgctgctcgaccggatggaggtcattgagcttggctcgtataccgacgaagagaagctccagatcgtcaagcgccacctgcttcccaagcagctggccaagcacggcctgaagcgcacgcaggtacgcgtctccgacgatgcgatccgtgagatcatctccggctacacgcgcgaatccggcgtccggaacctcgagcgccagatggcagccctctgccgcaagtgcgccatgcgcttcgtctcgccggagccgcccaagcggatcaccgtcaccggcggcaatcttgaggacttcctcggcgtgcgcaaatacctgccggaggcgaacatcacgaccgatcaggtcggtcttgtgaccggccttgcgtggacggctgtcggcggtacgacgctcgaggtcgaggtcaacgttgtcgatggtaccggcaagctggagctgactggcaatctcggcgacgtgatgaaggaatccgccttcgcggccatgagctatatccgctcgcgaacgaaggagctggggttgaccccagacttctataaaacgaaggatatccacgtccacttcccggagggcgccgtccccaaggacgggccgtccgccggcattacgatctgcacggcgatcgtctcggccctgaccggccgcgcggtgcgccgcgacgtggcgatgacgggtgagatctccatc

SEQ ID NO: 2531 - DNA, 2229 bp, Unknown
  Description of Unknown: Firmicutes sequence
atggcaaaaaagatcattcgcctgccccgcacaaaggagcagatccaggcaaataaggaaaagaatcaacgggccaaccggacgattctgcgccgcacattggttttgatgatcgtgtgtggcattgtcgtttttatcccgcttatcgccacgctctataatctcatgatcaccgagcacgattattatgaagagcgcgccatcaaaaaccagactcgctcgaccagcctctcggcctcgcgcggcgtgatctacgacgcgaacatgaacgtgctcgcgtcgtcgtcgaccgttgagacggtcttcatcgaccccaacgagatcgctgagcagatgaaaaagccggaaaacagcaaccttctcgaccagatcgcccgcggtctcggcgagattctggatgtcgagccgagcttcgtctatgagcaggcggccgacaagcagtaccgctataagatcatcaagcgcaagatccccgaggagctggctgacaaggtgcgcgcctttatcagcgaaaacgagatcaccggcgtctatctcgagaccgacctgcagcgctattaccccaattcctccctcgccgcgcaggccatcggctttgtctcgagcgacaataccggctccgagggcctcgaagcatattataacgacgagctgtccggtaccgccggcaaggtcgtcacctccaagggcaactacggctccgagatgctctatacatatgaaaaatactacgatgcatccgacggctgcagccttgttacgaccatcgacgcgaccgtacaggcgtatgtcgaaaagaacctgcaaaacgccatcgataaatacgacatcaaaaacggcgcgttctgcatcgttatggatgtgaacacgggcgagatcaaggccatggccacgctcggctcctacgaccccaacaattatctcgaaatttacgacgagtcggtcgacctcatgctggaaaacgagcatgacgcggccatctctctgccggaggcatccgacgcgtataaggcggcaatcgagcagtataacgccgacgtcgccgcggcccgccttgcccagtggcgcaaccgctgcgtgtccgacggctatgaacccggctcgaccttcaagctcatcacgctcgcgtccgccctcgattccggcgccatcacgctgaacgattcgttctactgcggtgggcaggaaaagtttgccggccgtgaccagatcctgaattgctggaaatctgccggccacggcgcacagacgaccgcgcaggccctcggaaactcctgcaacatcgccttcggccatatcggcatgcgcatgggcggcgatacgttctatgattatctcaaggccttcggcatcatggaaaagaccggcgtcgacctgccgggcgaaggcagaggcctgttctacgacaaaaagacgctgactgacacggcgacctacggcacgtcgtacctcatcacgtcctccttcggccagagcttccgcatcacacccatgcagctcgtgcgctccgtcgcggccatcgtcaacggcggctacgtgctgcagccctatgtggtcagcgaggtcctcgacgaaaacggcaataccgtgcagacgaacgaaaagactgtcctgcggcaggtcatcagccagcagacgtccgagaccatgcgcgacctcatggaaaaggtcgtgaccgaaggcacggcgtccgcggccaagacgcccggctaccgcgtcggcggcaagaccggtacatccgaaaagctggacgaatacgacgagaacggccagcaggtcaaggataagatcgtctccttcgtcggcgtcgcgccgatcgacgatccgaaatacgtcgtccttgtcgccctcgatacgccggcctattcccagaatagcgaaaaatacaccgtccacggcatgtacatttccggcggcctgatggccgcgccgacagtgcgcgatattttcctcgacatcctgccgtatctcggcgtggagccggactacagctccgaggatatccgcggcgtcaacttcaccgttcccgatgtgatcggcatgagcgagaccgaagcggccgcgctcctgtccgagaagaccatcacctaccgcacggtcggctccggcgcagtcgtaacggaccagctgcccgcagccggcaatcaggtgccgggcaattcggagatcattctatacttcggcgcagaaaagcagcagaccatggtcgaggtgccggactttatcggc

SEQ ID NO: 2532 - DNA, 1956 bp, Unknown
  Description of Unknown: Firmicutes sequence
ggcacgatctggctgtaccgccagacgagccgctattccagcgatggcagctcggatgagacaatctcggagctcatccagctcgacgcgcacggcacgctgctgcggaccatcacgccggtctcggacgatgcatccgacaattccgatggctggtactacaccatcagcgatattttctccgacgacaagggctatgtctacacctacgattatcagaccctcaacgtctacggccctgacggaacgtttatctgcggcaaaacgggcgacgagctgaacggtcaggtatgccagctttcttccagcgaggtcggcatgaccagtgtttcggcggatgataagagcgtgttcagacagctcgaccctgagacaaaggattggggcagggaaacgccggtctcttccgacgcatgggacctcttccccggtaacgatgtgtacgcctatttctacacgagaaacggcagcatctacggcgagcggaaggacaccggtaagacggagaaggtcgtcgactggatgagctgcgacatcgacagcagcttcatcggcagtgatagcattgcattcttgtctgacggccgcattgccgcagtcctgtcggactacaaccgtcaggacggctccggccagcagcaggtcgttgtgctgacgcgggtggacgcatccagcgtcaagcagaagaccgagctgacgctggcctgctttggtctggactacaatctgcgcagccagatcgtcaagttcaacaaaaataacagcgactaccgcattgtggtgaaggactattcggagcttgccacggaggacgattacacggcaggtttgacgaagctcaataccgagatcatttccggcaatgtgccggatctgatcatgaccaaccagctgccggtcgcccagtatgcggccaaggggctgctggaggatctgtggagctatattgacgccgatccggaatattcgcgcgacgcgctcatgctccagccgatcaatgcggcgcagacggatggccatctctatcagatgccgatcgactttggcgttgtgaccgcgatcggcctgaacaagatcgtcggcggctacacgagctggacgctggcggacgtcaatgacgccctttccaagctgcccgagggcgcgactgtgttcaacaagtactatacgcaggccgaaatgctgcagtactgcgtggcgatgaacgcgtccaacttcatgaactggcaggacggcacctgcaattttgactcggacgagttccgcgctcttctcgagtttgtcaagccgctgccggcggattacaactggcagtcggacgatgaggactatgagagcgactattcccgcgttcgcgacggcaagcagctgcttttcccgacctcgatctctgattttgacaatctctattatacctttgctgctctcaacaacgacgtggccttcatcggcttcccgcgcgaggacggcagcagcggcaactgctttatctcgcaggtctctctggcgatcacaacggcctgcaaggacaagagcgcagcgtggtccttcatccgctccgcactgtcggacgactatcagacgaatatgtgggcgttcccgatcgtgaaatcggcctttgaggcgcaggcggccaaggcaatggagcaggagtatgagacagacgccaacggcaatcaggtgctggacgagaacggcaatcccattcccatctcgaccggcggcatgagctacggcaacgagccgatgatcgagctgtacgccgtcacgcaggagcagtatgatgctgtcatggatgtcatcaatacgacaaccagctatctggactacgatacgaatgtgctggacacgatctcgcaggaggctgcggcctacttctccggcgataagatggtggaagaggtctccaagctcatccagaaccgcgtcagcctgtatatgcaggaacagaaataa

SEQ ID NO: 2533 - DNA, 2613 bp, Unknown
  Description of Unknown: Firmicutes sequence
atgagctttgtgcatctgcatgtccacagcgaatacagtctgcttgacggcgcgtgccgcatcggctccatgatggaccgcgtgcaggagatcggccagagcgccatcgcgctgaccgaccacggcgtcatgtacggcaccattgatttttaccgcgcggcgaaaaaggccgggatcaagcccatcatcggctgcgaggtctatgttgcgcgccgcacgcggcatgacaaggtgcatggcgtggacaaagagccgtaccatctggtgctcctgtgcgaaaatgagaccggctaccgcaatctcagctatatggtttcacttggctttaccgagggcttctataaccggccgcgcatcgatatggagctgcttcgcgagcatcatgagggtctgattgcgctctccgcgtgtctggccggacgtattccgcagtcgatcatgcaggatgatctgcaggcagccgagcaggccgcgcgggaatacaccgaaattttcgggccggagcatttctatctggaattgcaggatcacgggatcccggagcagcgcaccgtcaacgcccagatccggaagctggcggaaaagctggatcttccgctcgttgtgacgaacgacgcgcattatctgcgcaagtcggatgcaaagatgcaggacgtgcttctttgcatccagaccggcaagaccgtcgacgatccgaaccgcatgaaatttgagacggaggagttttacctcaagagcgaggaggaattgcgcgcgctgttcccggacgtgccggaggcgtttgacaataccgtcaagatcgcagagcgctgtaatgtggaatttaccttcggcaagtatttcctgccggagttcaagcttccggagggcgtcacgagcctgtcgtatctcaaaaaactctgccgtgagggctttgacgagctgtatgggacggagcatccggaatatctgcagcagctcgactatgagatcgacatgatcgagaaaatgggctttaccgactatttcctcatcgtgtgggactttgtccgttttgcaaaatcggcaggcatcccggtcggccccgggcgcggcagcgccgcaggctccatggtgacctactgcctgcatatcaccgagatcgaccccatgaaatacggcctgtatttcgagcgctttctcaatcccgcgcgcgtgaccatgccagatatcgacatggacttcggcgacacccggcggtcggaggtcgtcgactatgtccggcaaaagtacggcgaggatcacgtggcgcagatcgtgacgttcggcaccatggccgcgcgcggctctatccgcgacgtcggacgcgtgctgaatttcacctatgccgagaccgacgccgttgcaaagctcgtgccgacgacgctccatatcacgctcaaggacgcgctgaagcagtcgccgcagctgaagcagatgtatgacgccgacgcgcgcgtcaaggagctggtcgacaccgccatggcgttggagggcatgccgcgcaacacctcgacccacgcagcaggcgtggtcatcacgaagctgccggtctataactatgttccgctcgccaccaacgacggcacgatcgtcacggaatacacgatgacgacgctggaggagctggggcttctcaaaatggacttccttggcctgcgcaatatcaccgtcattgacgacgccatccgcgatatccgtaaaacggaacccgatttctccatggcacgcgtcaccgataatgatccgaaggtcatggacatgctcacgcagggcaggactgccggtgtgttccagatggagtcgaccggcatgacgggcgtgtgcatgggcctcaagccgcagtccattgaagatctctccatcatcgtcgccgcctaccggccgggcccgatggaatcgatcccgcggctcatcgcctgcaagcaggacccgtcgcttgtcaaatacaagcacccgatgctgaagcctatcctttccgtcacctacggctgcatcctctaccaggaacaggtcattgagatcttccgcaagcttgccgggtactcgctcggacaggcggacatggtgcgccgcgccatgagcaagaaaaaggtcaaggacatcgaaaaggagcgcggcgcgttcatccgcggcgatgcttcgcggaacatttccggctgcgtggccaacggcatcccagagactgtcgcggaagatatctataacgagatgtacgacttcgcaaactacgccttcaataaggcgcattccgtctgctatgccgtcattgcgtatcaaaccgcgtggttcaaatgctattatccgcgcgagtatatggcggcactcatgacctccgtcctcgacagctcggtcaagatctccgaatatatcaccgaatgccgcgccatgggcattgcgctcctgccgccggatatcaacgaatccaacgataattttaccgtcgtcccgggcggcatccgctttgggcttgccgcgatcaaaaatatcgggcgcggcttcattctcaaagtcatgggcgcacgcgagcagggtgggaaattcacgagccttgaggattttgcctcccgcatgtacgggacggatctcaataagcgtgcgctggaaaacctcatc

SEQ ID NO: 2534 - DNA, 1152 bp, Unknown
  Description of Unknown: Firmicutes sequence
atgaccatggaagaacagatcccgcagctgacgctgacgccgaaccttgacgccgagccgcagccggtggtacagaaggaagaagatctcatcacaaaggcacaggccgcgcccgaagcggggccggatctgtccgccctgtcggcggcggaggagaaggcagtcctggagtttgcacagcagatcgatctggaaaatgcacagcagattctggaatacggcgcttcggcgcagaagaatattgcggatttttccgagacggcgcttgccaaggtcaagacgagtgaccttggggagatcggcacgatgctctccggtcttctcgtggagctgaagacgatggacgagccggagaagaagggcatcgctggtctgttccgcaaggcgaaggtcaacgcggaagagatgaagagccgctacgccgcggcggaggtcaacgtcgaccgcatctccggggagcttgaaaagcacaaggtgacgctcatgaaggatgtggcggtgatggatcagatgtatgaccggaacctgcagtatttcaaggagctgaccatgtatattctggccggcaagcagaagctggccgaggcgcgcaacaccacgctgcgcgaacttcgcgacaaggcggaagcatcgaatctgccggaggacgcgcagacggccaacgactatgagaacaagtgcatccgctttgaaaagaagctgcacgatctggagctgacgcgcatgatctgcctgcagaccgcgccgcagatccgcatgatccagaataacgacacggcaatgatggagaagatccagacctccatcctcaacaccattccgctctggaaaaaccagatggtcctgacgctcggcatcgaggattcacgccgcgcgatgcaggcgcagcggcaggtcacggatatgacgaatgcgctgctgcagaaaaacgccgacatgctgcacatggcgtcggtcgagacggcgaaggaatccgagcgcggcatcgtcgacatggagacgctcaagcatacgaacgagcagctcatctccacgatcgacgaggtcctgcagatccagagcgacggcgcgaagaaacggcaggaggccgaaacggaactgcggcggctcgagggcgagctgaagcaaaagctgctgcagacgcgaagctaa

SEQ ID NO: 2535 - DNA, 1251 bp, Unknown
  Description of Unknown: Firmicutes sequence
atgaaaagtaagctttttgccatgatcgtttccgtccttgcggcgatgtgcctgtgggtctatgtcgtgaccgtcgtcaaccccgacggcgatatggtgatcggcaatatccccgtgacgttctccggcgcggaggtcctgcgcgaggatcacgggctggtcatcaccggcgattatcaggaatttgtctccgtgcatttctacggaaaaaataccgacctcaaaacgctcgaccagcataaggatgagatcaaggcggtcatcgacgtatccaaggtgcgcagtaccaaggaatacaccatgacctacgatattacgctcccgagcgccgtctcggcgtcgtccatcacgaaaatggacaagaacccctcctcgatcaccttccgcgtcgagcggcagatcaccaaatcggtcgaggtcaagggcgactttgcaaacgtcaagatcgccgagggctacatgctcgacagcacgagctttgactatgattccgtcaccgtggaggggccggagtctatcgtcagcaccatcgattccgcacaggtcacgctcgaccgcagcaatgtggacaagacgatcaccgagtcggtctcctatgtcctgctggacaagagcggcgaacaggtcgacccgacggagctgacgctcagcaccgacgccatcgaggtcacgatgaagatcgtcaaatataaggtcgtacccatcgaggtacagctgctctacggcgacggtctgcaggagcaggacgtcagctatgactacgagccgaaggccgtgacgctttccggcgattccgctgtgctggacggtctcaattccatccagctcgacccgatcgacctgtccatgctcacgagcaacgacgagacggtcacgcagaccatcctcatcccgaatgacgcgaagaacgtctccggcgaggaaaatgtctccgtccgcatcaccatcaccggtaagcagatcaagacgctgcggacgaccaacatcgtcttcatcggcgtcgacgagacgcagttcaaggcaacgagcctttcccagcaggtgcaggtcaccatccgcgctgacgcggcggacgcaaacaagatcaccgcgaacaacatccggatcgtggcggatatgagcgcctacacacagacagggacctatcaggtgcctgtgaccgtccgcatcgacggctaccagagcgccggcgcgatcggtcagtattccatcgccgtcaatctcgcggcggcggacacggaaacggaataa

SEQ ID NO: 2536 - DNA, 1656 bp, Unknown
  Description of Unknown: Firmicutes sequence
ttggcagaaaaattaaaaatcatccccctgggcggtctgaatgagatcggtaagaatatgaccgttctggaatatgggaaggatatcatcatcgttgactgcggtcttggattcccggacgaggatatgtacggcgttgatcttgtgatcgccgacatgacttatctggtcaagaacaaggacaagatccgcggcatgttccttacgcacggacatgaggatcacatcggcggcattccgtatgccatggagcagttcaactgccccatccatgctacgcgcctgacggccggcattgtagagctgaagctggaagagcatcacctacaggatacggtccatctgtttacgcacgaggccggcgaaaaggtcaaggccggctgcttcacggtggagtttatccacgtgaaccactctatcgcggacgcagtggcgtttgccatcaagacgccggtcggcaccgtcgtgatgacgggcgatttcaagatcgacgccacggcggaggatggcatgatcgatctggcccgcttcggcgcactcggcaaagagggcgtgcttgcacttctgtgcgattccaccaatgtggagaggcagggctacacaccgtcggaaaagacggtcgccgcgagctttgagcggcagttcatgggctgcaataagcgcatcatcgtgacgacctttgcgtctaatgcgttccgcttgcagagcctcattgcggtcgcaaagaaattcgggcgcaaggtcgccgtgaccggccgcagcatggagaatatcctgaaggtctccaccgagcttggttatctgaagatccccgccgggacgctcgtcgatatcaaccagatcaagcagatcccgaacaataagctcgtcatcgtctcgaccggctcgcagggtgaaaatatgtccgctctgtaccgcatggcgttctccggccaccggcaggtggagatcacggcgtctgaccgcgtgatcatctccgcttccgccatccccggcaacgagaaggcaatcggcaagatcatcaatgagttgtaccgcaagggtgcggacgtcatctatgacaagctcgaaggcctgcatgtctccggccacgcctgccaggaggagctgaagatcattcacggccttctgaagccccgcttcttcatcccggtacacggcgagcagcgccatctgcaggcgcattcgcgtctggcacagagcatgggcatggatcccaaaaacatctttatttccgacatcggcaaggtgctggagctgaccaaggggacctgcaagtggggcgggaccgtcccgtccggcaagatattggtcgacggtaccggtgtcggcgacgtcgggagcgtcgtgctgcgtgaccgcaagcatctggcgcaggacggcatgctcgtcgtcgtcgtcaatatctccagtgaagacggcagcgtcattaccgggccggatatcatcacgcgcggctttgtctatgtcaaggaatcggaaaatctgatggaagagctgcgggtcatcgccgcgcacgccatcgaccggtgcagccagaacgggcgcagcgactggagcgtcctcaaggccaatatcaagaatgatctttccggctatctgttcaagacgaccaagcgcaacccgatgatcctgccggtcattatggagatctga

SEQ ID NO: 2537 - DNA, 1428 bp, Unknown
  Description of Unknown: Firmicutes sequence
atggcggcaaaacagaagctttccggcagaaaaggagctgatcgaatgcagatcgtcatcgtgggcgacggaaaaatcggcagtgcactggctgagcagctttcccgcgaagggcacgagatcaccatcgttgaccgcagcggcgcgccgctgcagcagaccgtcgaggatcttgacattctgagcgtcgaaggcaacggcgcgacctacgccacccagatggaggccggcgtggacgaggctgatcttgtcatcgccgtcacggcgcaggacgagctgaatctgctgtgctgcctgatcgcaaagaagatcggcgcccggcacaccatcgcccgcgtgcgcaatcccgaatacgcgggcgagctttcgctcatctccgacgatctggggctgagcctgtccgtcaatccggagctgatctgcgcgaccgagatggcgcgtacgctccgcacgccgtcggccatcaagaccgacacgttcttcggcggcaaggtcgagcttctcaagttccagctcccggcggactcgccgctggccggcaagacgctcatggagctgcccgccgtcacaaaggcaaaggtcctcatctgcgcagtcgagcgcggtgagcaggagatccatatcccctccggccagttccgcctgcaggcgggcgaccgcatctcgttcgtcgcgtcctacggcggcgcgcagcagtttttccgccagatgaagctggcctccggccgcgtgcgcagcgccatgctcatcggcggcggacgcatcgcgtattatctcgcccggcagcttctcgaggccgggctggacgtcaaggtgatcgactccgaccagagccgctgcgcggagctttccatcgccctgcccaaggcagaaattctctgcggcgacggcacgaacgaagcgtttctgcgcgagtgcggcatcgagtccatcgacgccgtcgcggcccttacgggcatcgatgaggaaaacgtcctcattggcatgtacatccgcaagacctggccgaaggtcaaggtcatcaccaaggtcaaccgcacctcgttccagtcgatcatcgacagcatggatctcggcagcgtctttaacccccgcaattccgcctcgaacctcatctgccgctatgtccgcgccatgcagaactcggagggcagctcacagatcgagacgctctacaagctcgtcggcggcaaggccgaagcgctggagttccgcgtgtccggcagctcccggctctgcggcatcccgctgcagcagctgcagctgcgggaaaatctgctgatcggctgcatcggccgcggcggaaaaattctcatccccagtggtcaagacaccatcgagccgggcgacagcgtgatcgtcgtcacgtgcagcgcgggtctcggcaagctggaggacattctcgccagagggaccggccatgaataa

SEQ ID NO: 2538 - DNA, 1368 bp, Unknown
  Description of Unknown: Firmicutes sequence
gtcctgatctggatccttgccgtcctgcttctgctgtcgatggtcggctgtgccgccggcactgccaacaccacgaccgacaagtacgcaggtatggagcctgccgcggccgctgagtctgccgcagcagagacgaaggataccaccagtctgtccgatatcatccgtgttccgttcggatatctgctcgactggctgtataccgttaccaataactacggtctggcgctcatcctgttctccctgatcgtcaagctggtgcttttgcccatgtcggtcaagagcaagaagagcatgctcaagatgtcccgcctgtcgccgcaggtcaaggcgctcgaagccaaatacggtgacgacaagcagaaatatcagctggctgtccagcagatgtacaaggaagagggcgtctcgatgggcggcggctgtttgtggtcgtttatcccgctcatcattctgctgcccctctactacgtcatccgtgagccgatcacctacatgatgcacaactcccgctcgatctccgaggcgatcgtcgccttcatgcaggccagcggcgtcaatctcggcaagaacgcatactatgcgcagcttgccgccgcgggtcacatcggcgagttcatggatgagctgaaggcgctggccgtcacggcgaacgcccatctgcaggccatgaacttccagttcctcggcatcgatctgtccggcatcccctcgttccgcttctgggagtgcgagggctggggcgagatcggcctgttcctgatcccggtcgtctccgctgcgctgcaggcagtttccatgctcatcagccagaagatgaacaatcaggtcgcgaccaacgccgacggcgaacaggacgcagaggctgccaagaccgccaaccagaccaacatgaccatgatgctcatgatgccgcttatgtccctctggatcggcttctcgatgccggccgcgatctcgatctactggatcgcgcaggccgtgttcggtgcgatccaggactacatcctgacgaagcactaccgcaaggtctatgaggaagaggacgccatcaagcaggagcaggcagccaagcgccgcgccgaagaggcggaaaaggagcgcgtgcgcgccctgcgccgtgagcagaatcccgacggcattaccgacaacgtcagcaaaaagaagatccggcagcaggaaaaggaagctgccgaaaaggccgccagagaatacgaggcaaagaagaacccagtctctgagaacccggaaaagaagccgctctccggcgatccggagcgcccatacagccgtggccgtgcctatgatccttctcactacggtaaaaagcgttctgccggcgctgaggcggaacagacgaaggagtaa

SEQ ID NO: 2539 - DNA, 1626 bp, Unknown
  Description of Unknown: Firmicutes sequence
ttgttgagagcaggctttccgcgtagttctccaaaaacgctgcccgccgcagcgtttttgcaaaaaggcggagcgaattccctgacagaaaggatgacatgcttggaaaacgcaatcgaactgagaaacataaccaagcgctttggccaggtcgtagcaaacaaatcgatctgtctggagctgcataagggcgaaatcctgtccctgctcggcgaaaacggcagcggcaagaccacccttatgaacatgctgtccggtatctactatccggacgaagggcagatttttgtagacggcaaggaagtggagattcgctcgccgaaagacgcatttgatctgcacatcggcatgatccaccagcacttcaagctcgtcgacgtgtttacggccgctgagaatatcattcttggtctgccgggcgacaagggcaagatggacaaggccgccgtcagcaaagccgtccgcgagatcgccgaccgctacggcttcgacatcgaccccaaccagaagatctacgagatgtccgtttcgcagaagcagaccgtcgagatcgtcaaggtgctttatcgcggcgccgatattctgatcctcgacgagccgaccgccgttctgaccccgcaggagacggaaaagctcttcaccgtcatgcgcaacatgaaaaaggatggcaaggccatcatcatcatcacccacaagctgcacgaggtgcttgccgtgtccgaccgcgtggccgttctgcgcaagggagaatacatcggcgacaccgagaccgccacagcttcgcagcagtcgctgaccgacatgatggtcggccgtgccgtgagcctgaatattgaccgtccggtcaacgaaaaccaaaccgagcgcctgaaggtcgagcacctgaccgtcaagaacaaggaaggcgtcaagatgctcgacgacgtgaccttcaccgccatgggcggtgagattctcggcatcgcgggcatcgccggctctggtcagaaggagctgctggagtccatctccggcctgcagaagctcgaagagggcagcaaaattacatacatcgagccggacggctccgaatgcctgctcaacggcatggatccgctggatatcatccgcaagggcctgcttctgtccttcgtcccggaggaccggttcggcatgggtcttgtcggtggcatgaacatcatccagaacatcatgctccgcacctaccgccgcggcaagggtccgctcaccgaccgcaaattcccgcgcgacctgtcgcagaagatcgtcgacaatctcgaggtcgtcacgcccgacatcggccgcacgccgatccgccgtctgtccggcggcaacgtccagaaggtgcttgtcggccgtgagatcgcgcagaaccccgccgttctcatgacggcctacgccgtccgcggtctggacatcaacacatcctacgtcatttacaacctgctgaccgagcagaagatgaagggcgtcgccgtaatttacgtcggcgaggacttggatgttctgcttgagctgtgcgaccggatcctggtcctgtgcggcggcaaagtttccggcatcgtggacggccgcaagaccaccaaggatgccgtcggcctgatgatgacaaagattggaggttaa

SEQ ID NO: 2540 - DNA, 1356 bp, Unknown
  Description of Unknown: Firmicutes sequence
atggcatttgaaggcttaaccgaaaagctctcgaacgcattcaaaaagctgcgcggcaagggccgtctgtccgaggccgacgtcaaggaatccatgcgcgagatccgtctcgccctgctggaggccgacgtcaactacaaggtcgtcaaggacttcatcaaaaaaaccaccgaacgctgcgtcggcacggacgttcttgagagtctgacgcccgcacagatgattgtcaagatcgtcaacgaagagctgaccaatctgatgggcagcgaaaaccagaagctgaagctcgcctcccagccgcccacggtcgttatgctggtcggcctgcagggcgcgggcaagaccaccaacggtgcaaagctcgccgggcttttcaaaaagcagaacaagaacccgctgctcgccgcctgtgacatctaccgtccggccgccatcaagcagctgcaggtcgtaggcgcgcagctcgatatccccgtctttgagatgggtcagacgaacccggtcgacattgcaaaggccgccgtcgcccacgccgtccggcacggcaacgacatggtcttcctcgatacggcaggccgcctgcacgttgatgaagcgctcatggacgagctgaaggccatcaaagcggctgtgaagcctgatgagatcctgctcgtggtcgacgccatgaccggtcaggacgccgtcagcgccgccaagacgttcgacgagtacctcgacattaccggcgtcatgctctccaagctcgacggcgacgcaagaggcggcgcggcgctgtccatcaaggccgtgaccggcaagcccatcaagttcatcggcaccggcgaaaagctcgaccagatcgagccgttccatcccggccgcatggcctcccgcattctcggcatgggcgacatgctcacgctcatcgaaaaggccgaagccgcgttcgacgcgaagaaggccgccgagctggagcagaagctccgctccaacaaattcacgctctcggatttctacgatcagctcacccagctcaagggcatgggttcgctcgacgagatcgccggcatgatgcccggcatgaacgcgggcgcgctcaagggcgcgcagatcgacgaaaaggccatggtccgcaccgaggccatcatccagtcgatgacgccgtatgagcgcgagaatccttccgtcctcaactccagccgcaagcgccgcatcgcgctcggctccggcgtcaaggtcgaggatatcaaccgtcttctcaagcagtttgagatgatgaatcagatgatgaagcagttctccggccctggcgcttcgcgcaagatgaagcgcatgagcaagatgggcggcttcccgggtctgcccggcatgtaa

SEQ ID NO: 2541 - DNA, 1833 bp, Unknown
  Description of Unknown: Firmicutes sequence
atgtgtggtatcgttggatacgtaggaaagcagcaggcggctccgatcctgctggagggtctgtcgcgcctggaataccgcggatacgattccgccggcatctgcgtggaacaggacggccgtctggagatcgaaaaggccaagggccgtctgcagaacctcattgcaaaaacggataacggtgcttccctgcccggcacgctcggcatcggccatacccgctgggcgacccacggcgagccgaatgacatcaactcccacccgcaggtctctcagaacggccgcatcgccgtagtccataacggcatcattgaaaactatctggagatccgcgaatttctcgaggaaaaaggcgtcgtctttacctcgcagaccgacaccgaggtcgttgcgcagctgatggagtactgcatgcagctgccggaggtgcagacggtctcggacgcactgtacatggtcctgcatcggatcgagggcgcttacgcgctcggcattctttccgccgacgacccggcgcacatctatgccgcgcgcaaggacgcgccgctgctgctgggcttcggcgagggtgagaatttcatcgcctccgacgtgacggcactcgtcaaatacacccgtgacatcgtgtacatggacgacggcgaggttgccgtcctcggctgcgacggcattcaggtctacaatgcgatggagctgcccattgaaaaggagcatcatcacatcgactgggagatctcggccgcggaaaagggcggatacgaacacttcatgctcaaggagatcatggaggagccggaggcgctgcgccgcgccatcctgccccgcatcaaggacggcaaagtcgtttttgagggcctgcagctggatatccgccagtatcactccatcaagatcatcgcctgcggctcttcgtcgcacgtgggcatggtcggcaaatataaccttgaaaagctgacgcggatcccgaccgaggtcgtgctggcctccgagttccgctactgcgaccccatcatcgacaacaagacgctcgtcatcgtcatcagccagtccggcgaaacgcttgacaccatggccgccctgcgcgaggccaaggcgctcggcgcgcggagcctgtccatcgtcaacgtcgtcggcagctccatcgcccgcgagtcggacgacgtcctgtacacttgggccggcccggagatcgccgtggcgacgaccaaggcctttgtcacgcagatggcaatcatcgatctgttcgccgtctggctggccgcacagctgggacggctgagcgaggaagaggaagcccgcctcacggcagccattgccgctctgcccgcacaggtcgagcagatcctctccagccgcgagcggatccagtattacgcgtcgcagtattttaaccacgattccgtgttcttcatcggccggaatctggactatgcactcggcatggagggttctttgaagctcaaggagatctcctacatccactccgaagcgtacgcgtccggcgaactgaagcacgggacgatctcgctgatcgagccgggtacgctcgtcgtggcactgggaacctattccccgctctttgacaaagctatgagcaacgtcatcgaggtcaaggcccgcggggcgagcgtcctcgcgctgaccacggagcagaaccgtgaggagatggaaaagcgcgtcgacggcatcctgaccatcccggacacggagctgtcgctcctgccgcttctgggcgtggtgccgctgcagctgttcgcgtactatgtcgcgctgcagcgcggctgcgacatcgataagccccgcaacctcgccaagagcgtcaccgttgaataa

SEQ ID NO: 2542 - DNA, 1614 bp, Unknown
  Description of Unknown: Firmicutes sequence
atgaaacgaaagctgcttgcgctgacggcgcttattctggcgctggcgcttctttgcggctgctcgtcggtgaacgcgggcgaactcatgaagcagctcttccccgccaaggacgagagcgtcgccagccagcagaccggcgatatcagcagcatctccaatgagccggagggaacggccgtcgtaacggaaacgtacacgcagatcgagtccttcggcctcgcctatcagccggactacggcctgcagccgtataactgccagagtctcaataaccgcatcattttctcgttcctgtacgagccgctgttctccgtgacaagcgattatgaggccgtgcccatcctcgcggagggctataccgtgacggacgacggcaaaacgacgaccattacgctccgcaccggcgtcacgttccacgacggcagcgccatgacggcgcaggacgccgcctattccatttcctccgccgcaggctccgactattacggctcacgcctgcgctttatcacggccaccgacacgccggacgaccggacgctcgtcatcaccacgagtgaatcctatgagtgtctgccgctcctgctggatatccccgtcatcaagtccggcacggcggagcagcccgtcccgcccggcaccggcccgtatcagttcgcgcagacgaagctgacgcgctacgccggctggtggcaggagtccgcgccgctcgtcgattttgacgagattgcactgaccgaggcctccacctccgccgatgtgcgcgacaattttgaataccagaaggtcaacatggtgctgaccgaccccaattcctccgcctttgccggcttccacaacgactatgagctttggaacgcggacacgaccatcatgcagtacatcggctacaacatgaactcgactgtcttctccaactatggtctgcgcggtgcgattccctacgccatcgaccgcgaggcgctggtcgagcaggtcttcggcggctttgccgcggcgtccacgctgccctgcgcacccaattcccggtattacgacgtcaagctcgccaacagctttgcctatgaccccggcgcgtattatgaccagctggccagcgcatcggtcgaggacgcgaccggcgacggcattctggatctctatgtcccctccaagggctattccgtcccggtcgagggtacgatgatcgtctgctcctcgagctacatccgcgtgcaggctgccaacgaggtcgccaggatgctcaactcgctcggcttcaatatcacggtcaaatccatggagtattccgagtataagcaggcgctgctgctggggaacttcgatctttactacggcgaggtccggctgtcaccgaactttgacctctcgccgttcttcggcgcgaccggcacgctcaactacggaagcctgtccgacagcacgatgatgaacctgtgcagcatggcgctggtcaacagcggcaacacctacagtctctacaagcgcgtctgcgagcgcggctatctcacgccgatcctcttcaaaagctacgcgctctacaccacgcgcggcgccgtcaccgaaccgacgcactacatcgactggttcctgccggtcacagacccatcctga

SEQ ID NO: 2543 - DNA, 1509 bp, Unknown
  Description of Unknown: Firmicutes sequence
atgagcgcatcccgcgaaaagaacaagcgcaaggaacagacagcctccccggagactgccaaggaaacgaagaaaggcatgggcaagggccttaagacgactttgatcgccgtatgcgctgttctgatcgtctgcatcgtcgttttcttctatatgctgaccagcggcttctttgccggccacaccaccgccgccaccgttggctcccacaacctcagcccggccatggtcaactacttctacaagagcgcctacaccagcctgcagaatacctacggcacctatatggactacatcatcgactccgatacgccgctcgacgagcagtattatgacgagtccgccggtacgacctgggccgacatgctgaccgagcagggcatgaccacggctgccgaggcctacgccctctatgacgaggccatggccagcggctacatgctctccgagaccgatcagaccaccatcgacacgcaggtctccacgctcggtctgtacgccgccacctacggtaccaccaccgacgcctatatcgccgctgtctacggcacgggctgcaatgagaagaacttccgcgagtatctgaaggtcgtcaccgttgccgagagctatgcacagcagatccgcagcagcttcacctacagcgatgcggatatcgccgacgagtatgccgccaaccccaacagctatgacagcgtcacttaccgccagttcctcgtctccgaccccatgttccagacctcgtctgaggacgttgaggcaggcgcggctgagctgaccgaggacgagctgaccgcgaagaaggaagagatggcctccaggatggctgaagacgccaagggcgacgagcaggccttcatcgacgcggcctacgacaacgccaaggaatccgacaaggacacctacgcagaggacagcgccacgctgcgcgagggtgcgttctacacctccgttgacagctccatcgccgactggctgttcgacagcgcccgcaccgagggcgacacgacctatatcgtctccgacagcggcgtgtactatgtcctgtactacatctcccgcagcacgaacgagtatcagctgccgaacgtgcgccacatcctgatctccgtcagcgacaccacggatgaggccgcgatggaagaagcccgcaccaaggccgagagcattctgaccgagtatgaggccggcgagcatactgccgacgcattcggcgcactggccaaggaatacactgacgactccaacggcgacgaaggcggtctgtacaccaacatcaccccgggccagatggtcaccgagttcaacgactggtgctttgacgagagccgtcagcccggcgacaccggcatcgttgagacgagctacggcgtccacgtcatgtacttcgacagcttcggctccctgtaccgcgacgtgctggtcgaaaacgccctgcgcagcgccgattatacggcatggcacgacgaagtcaccagtgacagcagctacacgctcattcccttcggc

SEQ ID NO: 2544 - DNA, 1248 bp, Unknown
  Description of Unknown: Firmicutes sequence
ttgaaggaacatgaagaccggaagtatatcaaagttggactgaccgcgctggctgttatttttatcagcattctgctcgtcgtgatttttacgaatctgccgggctttttcgccatgctgcaggcgctgggcgccattctggagccgctgatcttcggcgtggtgatcgcgttcctgctgaacccgatcgtccggttctttgatacccggctcatcccgctgctggaaaagcatacaaaatggaagccggccgccatccggcacctgagccgcgcgtccggcgtcgtggtggccctcattgtcgcggcgctcattctctacgcgttcttctccatgctcctgccgcagctgtatgacagcgtcgtcgggatcgtgagccacgcggaggattattacaagagcatcgaccgctgggtcacgaatattctcgaggataacccggatctgcgcggctatgtcgatacggcgctgggcaagatctacgatttcgtcaacaactggatcacgacgaccttcctgcaggatgtgcagaaaatgctgaccacgctgacaagctcggtcgtctcgatcgtcaagagcctcatgaatctgctgatcggccttgtggcctccgtctatattctctggtcaaaggatacgttccacgcgcaggccaagaagatcaccgttgccctgttcccggagaagcatgcagaccatctgttttatcttgggcgcaatatttaccgggtgttcaacggctttgtcatcggcaagatcgtcgattcggcgatcatcggcgcgctgtgctactttgggctgctggcgctcaagatgccgtatccggctcttgtggccacggtcatcggcgtgacgaacgtcatcccgttcttcggccccatcatcggccttgtgccgtgcgcgttcctcattctgctggtcaatccgctgcaggcgttctattttgtgatcttcatcctcgttctgcagcagatcgacggcaacgtcatcgggccgaagatcctcggcaataccgtcggcatctccggcttctgggtcctcgcctcgatcacgatcgcggcaagcctctttggcttcgccgggatgatcctcggcgtgccggtcttcgccatcatctatctgctcatttccgactccgtcaacaataagctccgcaaaaagcagctgacgaccgataccgatgcctactgcggcatcgacaccgtcgccgatctgccgcaggaaggaccggcggagcaggacacataa

SEQ ID NO: 2545 - DNA, 1227 bp, Unknown
  Description of Unknown: Firmicutes sequence
gttttccctatgaccgtcattgaccgctttctgaagcttgtttcctaccccacgacctcggatgaagcatccgagacctgcccgtcgacggcgcggcagctgaagcttgcgcaggagcttgtccgccagatgcaggacataggcatttccgacgcccacgtcgacgccgacggctatgtctacggcaccatccccgcgaactgtgagaaaaagcttcccgtctacggtctcatcgcccacatggatacgtctccggacgcgccgggtgagaatatccatgcccgcatcacggaggcctatgacggcggagatgttgtcctgaacgaagcgctcggcatcgtcctgtccccgaaggactatccgcagctgaaaaatgccgtcggcaagcacctgatcgtcaccgacggcacgacgctgctcggcgcggacgacaaggccggcgtggcagagattctctcggcggcgcagctgctgctctcgtccgacaggccgcacgggaccgtcaggctcgcctttaccccggatgaggagatcggccgcggtgcagaccggtttgatgtggccgggttcggcgcggattacgcctacacggtcgacggcggcgggatcggcgagctggaatacgagaatttcaacgccgcgagcgcgaagatcgtcatccacggcaagtccatccaccccggctccgccaaggggcagatggtgaatgcctcgctcgtcgccatggagctgcacagtcttctgcccgcgctggaaacgccctactataccgaaggctacgagggcttctatcacctgaccggcatgcagggcgagaccgaacaggcggagctgcaatatatcatccgcgaccatgaccgggcaaaatttgaagcgcgcaagcgcgtcatggagaccgtctgcgcggaaatcaaccgccgctacggcgcgggtacggccacgctgacgctgcgcgacagctattataatatgaaggaaaagatcgagccgtgcatgttcctcattgacaacgccgcagacgcgatgcggcagctcggcatcacgccgaagattgtccccatccgcggcggcacggacggcgcgcggctctccttcgagggtctgccctgcccgaacctctgcaccggcggcgaaaacttccacggccgcttcgaatacatccctgccgaagacatggaagccatcaccaacctgctggctgcgatgctctggcgtctggcagaataa

SEQ ID NO: 2546 - DNA, 1722 bp, Unknown
  Description of Unknown: Firmicutes sequence
gtcctcctgccgacgacgttcccgaacgtcctcgtctcggccaatatgggcatcgctgtcggtatggcgtcgaatatctgctcgttcaatctcgccgaggtctgccggacggctgtcgcccttatcaaggacccggacgccgagcttctcgatacacttcccgcgccggatttccccacgggcggcgagatcctctatgaccccgcccagatgctccagatctacgagacgggccgcggctcgttccgcctccgggcaaaatggcgctacgtcaaagaggggaacatgatcgagatctacgagatcccctacacgacggccaccgagatcattctggacaaggtcgccgagctgatcaaggccaacaaggtccgcgagatcagcgacatgcgcgacgagaccgacctgaacggcctgaagctcaccatcgacctcaagcgcggcgttgacccggacaagctcatgcagaagctgttcaagacgaccacgctgcaggactcgttcggctgcaacttcaatatcctcatcgccggtcagccgcgcgtcatgggcgtgcgcgaaattttgcaggagtggacggcatggcgcacggaatgcgtccgccgccggctctattaccagatgaacaaaaagaaggacaagctgcacctcctcaaaggtcttggtaagatccttctcgatatcgacaaggccatcgccatcatccgcgagaccgagctggacgccgaggtcgtgccgaacctcatgatcggcttcggcatcgatcaggtgcaggccgaatacgtggcggagatccgcctgcgcaacatcaataaagagtttatcctgaatcgtctgaaggaaacggatgcgctggagcgggagatcgccgacctcgaggcgacgctcggctctgaaaagaaggtcaaatcgctcatctgcaaggagctggagcaggtcgcccagaaatacggtcagccgcgcaaaacgacgctcgtctatgaccacgagctgcagcagatcgaggacgacgagccggagaacgactacccggtcaccgtcttcgcctcgcgcgagggctatttcaaaaagatcaccgcccagtccttgcgcatgtccggtgagcagaagttcaaggagggcgacagcctgctgcttacgtgcccggcgcagaacgtggacgagatgctggtcttcaccgaccgctgtcaggtctataaatgccgcctgtccgactttgccgacagcaaggcctcggtacttggcgactatctgcccggcaagctcggcttcgacgagggcgagagcttccttaccgttatcttccccggcaaatacgaggggaacctgcttttcgtctttgaaaacggcaaggcggcgaagatcgccatgagctgctatgacaccaaatccaaccgcaagcgcctgacgggcgcatactcggacaagagtccgctgaaagccatcattgacctgccggaggagaagcagctcgccctgttcgcgaccgacggccgcgcgctcatcttctcgacggcacagctggccatcaagacgacgcgctctgcgcagggtgtggctgtcatgagcctcaagcgcaaggcggtcgtgcagacggccatggagctggaaaagacctcgatcaccaacgtcggccgctattcggcacggacgcttccggccgccggcgcactgatccgcgaagaggattccggcgaaacacagatgaagcttgatatttaa

SEQ ID NO: 2547 - DNA, 1965 bp, Unknown
  Description of Unknown: Firmicutes sequence
agcgctgcaacgttggatctgccgctgaccgggtatggcctccggtaccggtttggcctgttcaagcagtcgtttgtacacggctgccagcgggagaacgcagacgactggacgaaatacggtgacccgtggagccaccgccgcgacaaactggcggtcaaggtgaaatttgctgaccagacggtcaactgcgtgccgtatgatatgcccgttatcggctatcagacgaataccgtcgggacgcttcgcctgtggcagtgcgaggcggaggaagaactgaacttcgacgctttcaacgcgcaggactatgtcaaggcgctggaaaagaaaaacaaggcggaggatatcacccgcgtgctctatccgaacgactccacgtgggaaggcaagcgcctgcgcatcaagcagcagtatgtgctgtccagcgcgtcgctgcaggacattctgcgtgattaccgcgaggcgcacggcacggattattaccgcctgccggagttcgctgctgtccagctcaatgacacgcatcctgccatgtccattccggagctgatccggcttctgatggcggaaggactggattttgacgctgcgttcgagctcacgcgccgcgtattcgcctataccaaccatacggtcatgggcgaggcgctggaaaagtgggatttggagctgctgcgttccgtcgtgccggaggtctgtgagatcatcgagcgtatcgacgcgcggctcaagcaggggcatccgcattcgaacctctttatcgtcaaggacgggcaggcgcatatggcgaatctgtcggtctacgtgtccaccgcggtcaacggcgttgcggagatccattcgcagatcctgaaggatgacctgtttaaggactggtatgccgtctatcccgagcgcttccagaacaagacgaacggcatcacgccgcgccgctggctgggcctctccaacccggagctgtgcggtctgctcgacagcaagatcggcagcgggtatctcaaggacctcgacaagctggccggtctcagggatcagatcgatgaaatgaccgtcaagcagttcaacgccatcaagctcgagaaaaagcgtcagctctgccgcgtgatcgaggagcaggagggcgttgcgctcgacccgacattcatcttcgacgtgcaggtcaagcgcctgcatgagtataagcggcagcttctcaacgcgctgggcatcatggatctgtacctgtccatcaaggatggcagcatccgtgactttacgccgacggcattcattttcggtgcgaaggcagctcccggctaccgccgcgcgaaagcaatcattcattatgtcaaccgaatcgccgaccttatcaacaatgaccctgcgatgaacggcgtgatgaaggtcgtcttcgtgcagaactacaattgctcctatgctgagcatatcatccccgccgccgatatctccgagcagatctcgcctgccggtacggaagcgtccggcaccggcaacatgaagctgatgctgaacggcgcagtgacgctcggtacgctggacggcgcgaatgtggagatcgccgagcaggccggccgcgagaacgagtatatcttcggcgcgacggtcgaggagatcaacatggtgaagcccagctacaacgcgcgcagcttctatgaagcgaatccgaatctgcgccgcgcggtcgacacactgatcgacggcactgtcccgacggatgaggagcagcatgagctgtacacgtccctgctcgaaggcgccagctggcacaagccagatcagtatttcctgttctatgactttgacagctacaaaaaggcgcgtctggcagccaatcgggattacaacgaccgcatcgccttcggacgcaaatgcctgctgaacgtcgctgccgcggggaaattctcctcggaccgcacgatccgccagtatgcggatgagatctggcatatcaagcccgtaaaataa

SEQ ID NO: 2548 - DNA, 1026 bp, Unknown
  Description of Unknown: Firmicutes sequence
gtggcaaaggaaaaacagatcatttccaacgagtttgagcccgttgcatacgatccgcagtacattctgatggtcaatcacctgaagaagtacttcccgatcaagggcggccttctgtcccagaccgtcggccatgtcaaggctgtcgacggcgtcacgttcaatctcaaacgcggctgcacgatgggccttgtcggtgaatccggctgtggcaaatcgacgaccggccgtgccatcctccgcctgtgcggcgaaaaaaccggcggccaggtgctcttcaacggcaaggaggtctatgacctgtccgacgccgagatgcgcacgctgcgcccgaagatgcagatcatcttccaggacccgttctccagcctttcaccccgtctgcccgtcggtgagatcatcggcgaggccgtgcgtgagcataatctcgtcccgaagaacgagtttgacgattatatcgatcagatcatggacaactgcggcctgcagccgtaccacaagacgcgttatccgcacgaattttccggcggccagcgccagaggatctgcattgcccgcgcgctggccatgaatccggagttcgtcgtctgcgacgagccggtctccgcgctggacgtgtccattcaggcgcagatcatcaacctgctgaaggagctgcaggaaaagtacaagctgacatatctgttcatctcgcacgacctgtccgtcgtcgagcatatctccgataccgttggcgtcatgtatctcggcaatctggtcgaatacggcaacacgcaggacatctttgaccgtccgctgcatccgtataccaaggcgctgttctcggccatccccatcccggatccgaccgtcaagcgcgagcggatcgtcctgcagggttcgatcccgtccccggccaatccgccctccggctgcaagttccacaccagatgcccgtatgccaccgagcgctgcaagtgtgaagcgccgaagcagcgcgaggtcgaaccgggtcactatgtggtctgccaccagtatgacaaatga

SEQ ID NO: 2549 - DNA, 1041 bp, Unknown
  Description of Unknown: Firmicutes sequence
atggcgctttccgaacggaaaaagaagatcctgcgtgcgatcgtagatctttacatccgcacggcagagccggtcgcgtcgaagacgatcgcgcagatgccggacatggatttttcctccgccaccatccgcaacgaaatggccgagctgaccacgctcgggtatctggagcagccgcatacgtcggccggccggatcccctcgcctgccggctaccggctgtatgtcgacgagctgatgcaggactatcgcctgtccaccgatgaaacgaaatccatcaatcaggcgatggagatgaagatgcaggaggtcgacaaggtcgtctcgcaggtcggcaagctcgtctcgcagatgaccaatctcccggcctacgccatggcggcgcgcgccggcggtctgagcgtcaagcgctttgatctcattctagcggacgcgggcagcttcattctggtggtcatgctgagcgacaattccgtccgcaacaagctcatccggctcccggtcgagctgaccgagacggatctgaagctcctcggggccgttttgaacgcaagcgtagccgagctgacagccgagcagatcacgccggagcttctttcccgcgtgacaagaagcgcaggcgcggcggcaagcctcgtgccgatcgtcatggatttccttaccgagatcctgcacgcggaacacagcgaggtctatatgaccggtcaggccaagctccttggccagccggagtaccacgacatcgaaaaggcgcagaaaatgctgacgaccctcgatgaggatgtggtctccaaccttcccgcggcgctctcctccgacagccggacgcagatcctggtcgggccggagaacgtgtcgaaggagctgaaggacaccagcgtcgtcatgacgaggtttgacatcggcgacggcatgcagggtctgatcggcgtggtcggccccacaagaatggattacgcgcagatcaccgctcggctcagctactttgctgagaatctgagccgcatgttccagaagaaccagacgccggcactcgaaggg

SEQ ID NO: 2550 - DNA, 1428 bp, Unknown
  Description of Unknown: Firmicutes sequence
atgtgtgaaaaggagcgtttgaatatgtccgaatttaactatgattccaactatgaacccattcagcaccagcagtcctattcctacgaatgcagcggcggcccgcagccggcttcgcagccggaacccgcgccgcagaaaaagtccggcaaggccggcaaggtcgtcgccctgcttctggcgtgcgcgctggtcggcggcggctctggctggggtgcagccgcactggcacagaaaaacagcagcgcagccgctgctccgacagccgcttcgtctgacgcgtccgtcatgctcgagggccagcgccagaccgctgcgctgcaggttgcttccgtcgataccagcaaacttctgacggccagcgaggtctacgcgcagaacgtcaactccaccgtcggcatcacgacctccatcactaccaactacttcggctaccagaccacggccgcggccgcaggctccggcttcatcctgacgcaggacggctacatcctcacgaattaccacgtcgtcgaatcgtccgactccatcaaggtcacgacctatgacggcacgagctacgacgcacagctcatcggctatgacgagagcaacgacatcgctgttctgaaggtcgacgcaaacgatctgaccccggtcgtcctgggcgactccgattccgtcagcgttggcgacagcgtcgtcgccatcggcaacccgctgggcgagctgacgttctccctgaccgccggtgcgatcagcgcgctcgatcgtcctgtgacgctctcctccggcacgaccatgaacctcatgcagaccgactgcgccatcaactccggcaactccggcggcgcgctcttcaatatgtacggcgaggtcatcggcattaccaacgccaagtattccagctcctcgtccagctcggaagcgtccatcgataacatcggctttgccatccccatcaatcaggtgcgttcgatcgtcgagtcgatcatccagaacggttatatcgtcaagccgtatatcggcgtgagcgtctccgacgtctcctccgagagccagagctacggcctgccgcagggcgcggctgtccgctccgtcgtggaaaacagcccggctgcagaagccggtctgcaggaaaatgacatcatcaccgccgccaatggcgaggccatcaccggcagcaacgatcttgtaaagctcgtcaaggccgcttccgcaggcgatacgctggagctgaccgtctatcgtcagggccagaccgttaccgtcacgctgaccgtcggcgagcagaagcaggacgccctgcccgcgcagaccaccgacaatacccagtccgacagccaaaacccgtatggccagtacgaccagtacggcagccagaacggcgaccagtatggccaacagtacggcggctcgttccccttcggcttcagcttcggcggctaa

SEQ ID NO: 2551 - DNA, 801 bp, Unknown
  Description of Unknown: Clostridiales sequence
ttgattgactttataaataatagtaatcctgttattgctgctttaatagcaacaatgtttacttatgctgttacagtattaggtgccgcattagtatttttctttaaaaaagttaacaaaaatattatggatgcaatgctaggatttgcagctggtgtcatgattgcagcttcatttttctcattattggctccttctattaacatggcagaaagtttaaatatgattccttggcttatagcaagtattggcttttttagtggaggcgttttattatttattggagataaaatatttgattactttgcgagtaaaaaacagaatagtgattctactaaattaaaaagatgtttgatgttagtaacatctataagtattcacaacattccagaaggtatggctgttggagttgcatttggttctttagcatataatttagctggtgcaacaccacttgcagcagtattattaactttaggcattggacttcaaaactttcctgaaggaacagcagttagtgtacctttacgacgtgaaggtttatctagaaaaaaagcttttttttgggggcaattcagtggtttattagaaccaattgcaggtgttattggagctttattagtaataaaaattcaaataatgttaccatttttactagcttttgctgcaggtgctatgatatatgtagtagttcaagaattaattcccgaaagtcaaactaatgaaaaaaaagaccttatggccttatttacattaatcggattctcggtaatgatgattttagatgttgctttaggttag

SEQ ID NO: 2552 - DNA, 1137 bp, Unknown
  Description of Unknown: Clostridiales sequence
attactggaattttatgctcaatagcaacaggttttattttttataaaaagtatgaaacttcagctatagcttcttatgaaaatttaagtaacaataaaaatgtaaatgaatttttacaagtttatgcttcaattattaaagaatattatcaagatgttaatgaagaagaattagttgatagtgctataaatgctatgtttagttatttaggagataattattctgaacatttaagtaaagatgagacatcatcattgttagaacaattagcaggtgaatatcaaggaataggggtagagatatatcaggacaaaataatatataatgtgtttgatgattctcctgctaaagaagcaggattacaaaaaggtgataaaataataaaagtaaataatgaagatgttagcgaaaaagataatagttatgtagcaactaaaataaaaaaggaaaatgataaagttgaaataactattttaagaaataatgaagaaaaaaaagttactgtaaaaaaagataaattatatatcccttcagttactagtaaggttatagaagaagaaaataaaaaaataggttacatagatattacaactttctctaatactactagtaagcaagtaaaaaaggctcttctaagcctcgaaaatgataatattgatagtttagtcatagatgttaggaataacgctggtggttatttaattagtgctaaagaaattgctagcatgtttttagaaaaagagaaaattatatattcattacaagaaaaggataaaactcaaacatataaagatactacaagtgaaaaaagagattatcctgtagtagttttaataaatgaatatagtgcatcagcttcagaaatattaacttctgctttaaaagaaagctataatgcaactctagtaggtaaaaaaagttatggtaagggcaaagttcaacaaactttaaatttagaagatggaagtatggctaagtatactacagctaaatggctaacaccaaatggtaagtgtattgatggagtaggtataactccagattatgaaattgatttagatgttgatgaaaataatcaaacaattgttgatactcaattaaataaagcaatagaaatattaaaaaataaacaatag

SEQ ID NO: 2553 - DNA, 1197 bp, Unknown
  Description of Unknown: Clostridiales sequence
atggaaattttagcaaataaaattcgtcctactaaattagatgatattataggtcaacaacatttagttggtaaaaacaaagtattaagaaatttagtagataataagaaactattttcatgtattttacatggaaagcctggtattgggaaaaccagtattgcttatgcattagttaatgaattaaatatgccctatcgttttttaaatgcaacaattaataataaaagcgactttgatattgtaattgaagaagcaaaaatggaaggtcaaatgattgttatcatggatgaaattcatcgtctaaacaaagataagcaagatttacttttaccttatattgaaaatggcttgataattttaattggaatgacaacatcaaatccgtataacagtatcaatccagctattagaagtagattacaaatatttgaattaaaagaattaactttagatgatatagttactggcttaaaacgtgcttgcaattatttagaaaatattaaaatagaaaatgaagctttaaaatatatagcaagactatccagcggtgattttagaagtgctttaaatctattagaaatatgttattactcttctaataatcatgaaataacgatagataatgtaaaaaatattaattctaagccaacattttttcatgataaaaacgaagatggctactatgaagctctatctgcatttcaaaaatctattcgcggaagtgatgttaacgcagcgcttcactacttagctagattaattgaaggcggtgatttagatagtatttatagaagaatgagtgttatagcatatgaggatattggacttgcaaatccaatgatgggagtcaaagttatgagtgctatagaagccgccaaattagttggattgcctgaagcaagaatacctttagctgatgtggttattgaattagcaaaaagcccaaaaagtaatagtggtataactgctatagacaacgcattaaatgacattagaaatggcaatacagggaatgtaccgcctcatataagaaatcataatccaaattataaatatcctcataactaccctaattcttatgtgaagcagcaatatcttcctgataatattaaaaataaaaaatattatactcctaaaaataacaaatatgaaaatgctttaatggcatttgataaagaaagaagaagtgaataa

SEQ ID NO: 2554 - DNA, 1389 bp, Unknown
  Description of Unknown: Clostridiales sequence
atgaatttagtgcaaaagtattgtggggtgattgatttgggtaatgaaaaattatgggatagtttccttgatataatttataaaaagactaatcctgtatcttttaatacttggtttaataacatcagtctcctaaacattacaaataacaaaattagtattaaagtccctatggatattcacaaaaaaatattaagtaataactattattcattaatagaagatacatttatgagtttaactgggattaattatgatattgaatttattttagaggatgaaataaagaatgaaaatgttgataacttaacagttatcgacaataaagaagaagaaaaatgggaatctaatttaatagagagttatacgtttgataattttattgttggtgatactaatagatttgctaaaactgcagcgatagctgttacagaacaaccaggaaaaatatataatccactatttatatatggtaaaagtggtttaggtaaaactcatttaatgcatgctattggtaatcaaattatgaaaacttctaataaaaaagttttatacacaactagtgacatgtttatgaatgattttacggggattgctaagagtgatgataaaaataatttagaatatgcttatatgtttaaggaaaaatatcgaaatgttgatgtcttaattattgatgatattcaatatttagttggagcagataaaactcagcaagagttctttaatacgtttaatgctcttcatcaagcaaataagcaaataattataagttcagacagatcaccagatgatttaaagaaattagaagaaagattaagatcaagatttacttggggattacctgttgatatctatcctccagattttgatttaagatgtagaattttaaaaaataaaattaaaaatttagacattgctaacttaattgatgaagatgttattgagtatattgctaattcttgtgataatgatgtaagatatttggaaggagccattactcggctttgtgcttatgcagctatgactatacctaaaagaattgatatggaatttgctaatgaagctttaaaagactatataactaagaatatttatagtactggtgatattccaagtattcaaaaagctgtatgtgaatattacaatatttcagttgatgaaataaaatcaaaaaaacgaagtaataaaatagcctatccacgaatggtagctatgtatttatccagaatgctaaccgatgaatcattccctagaatagggctagaatttggtggtagagatcattcaacagttatccatgcttgtgataagattgaaactgatttaaaaacatcttctgaattaaaggaagctgttaataaaataaaaaataatataagttgttga

SEQ ID NO: 2555 - DNA, 978 bp, Unknown
  Description of Unknown: Clostridiales sequence
atgaaaatagcaatggtcggctgtggagcatacagcttagcagtaagtttaagattaaatcaaaataacaataatgttacaatttggtcagagagcaaagaaaaagttgacttagttaataaaaagcatcaattaaatgatattttaaaaggcgtaaaaattccaaaagaaatcgaatttactacatcattagaagaatgtgtaaaggacaaagatgttatttatgttattgtagctgctcaatatatttatgaaactatgaataatattaagaaatttattaatcatgattcaataatatgtattggaactaaaggaattgaacaagaatcttgcaagtttattcatcaaataacagaagaagttactaaatgtaagcatgttgtagtgatgtcaggtccaagctttgccattgatgtagcaaataacaatcctgtagctttaacattagcaagcaaatctaaagacgctatagctaaagtgagtaaaacattaaactctcctactgttaaattacaagaaactcaagatgtagttggagttgaattatgtggtgctattaaaaatgttattgctatagcagcaggtatcataaatggacttggctatcaagaatctacattatcattcttgattactgaatcaatgtatgaaataaaaaatattataaaacatttaaatggtgatgaaaaaactattctaagttatgcaggcattggagatattatattaacatgcactagtacaaaaagccgtaattttagttttgggaaatttttaataaatgctacattaaatgaaaaaaataactatttaatagataataccgttgaaggatacagcagtttaaactctattagtaaaatattaagtaggaatgatatagaaagtgaacttataaatactttatatgatatagtgtttaaaaatgaagatccaaatattttaatagaatggttaaattcaagtaataaataa

SEQ ID NO: 2556 - DNA, 1026 bp, Unknown
  Description of Unknown: Clostridiales sequence
atgaatgtaatagtatcaaataaatttcaaactcaactaaatacattacaaatcgatgttattaaaagcgtaaatggagaatttactcccgaagaaatagtagaaatgtttgctaacttcttctttaataaaatgatattagatgttacagctattaaaggatatcaaaatgttgcaaatcttcaaagattagctgtaggtatagatatgagtaaagtaatattagttttagatgatagtgatgtaactagctctggtcaatatttatctcaaattatatctatgggtatttataactttacacgtaatattgataatattccttttttaatagataatccaaatacgtataaagatgttgctcaataccaacaaattagtactgttgccaaagaaattgtaaacaaacatgaaactcaaaaatttgaaatggatgatgttactgcaggtggctttactacaataataggtattaagaatgttactgatcatgcaggagcaactacactaatatatatgctaaaaaaacaattacaagtaaattataatgttttagctatagaagttgatagaaatgattttgtttattttaacgatccgcaattaattagtattagtggagatcaattggaaggtacaattagaggagcaaatacatatgacattattttagtagatttaaataatagtggagatgaagatgcttgtactgatgtattatatttattagagccaagtactattaagttaaataaaatgattagaaaaaatagaggaatatttgattcattaaaaggtaagaaaatagttttaaataaaagtttattagataataaagatgtaatggattttgaatatgaatcacgtagtcaaatattttataatattccgcctttagatgataaaaaagaaaaacatcgtgtacttgacgatatgttgtcacatttaggatttattagacagaagaataataatttagggcaagaaaagactaagatactaggcattttcaaaaataaatcttga

SEQ ID NO: 2557 - DNA, 2613 bp, Unknown
  Description of Unknown: Clostridiales sequence
gtgtcatttaaaattgcaaaatttggagaccatagagaaagaagaactttctcaaaaacaaagaacaccttagaattaacagacttattagaaatacagaaaaaatcatttaattggttcttagaagaaggaatcagagaaatatttgatgacttattcccagtagaaagttttacaggtaatatttctttagaatttggagaatattcttttgatgaacctagatattctatcaaagaagctaaagaaagaatggttaactatgctgcacctttaaaggtacaagctcgtttatttatccatgaaactggtgaagtaaaagaacaagaaatattcttaggcgacttaccaatgatgacagatgcaggaacatttattatcaatggtgcagaacgtgttattacttctcaattagttcgtagtccatcaatttattttaaaagagaaattgataaaaacggacgtcctgtagttagtggggaagttataccaaataaaggtacttggttagaatatgaacttgatgcaagagatgtattatatgttcgtatagatcgtactcgtaaagtaactataactacattcttaagagctttaggattgtctaatgatgaagatattataagtgtatttggtgataaccagtatattcaaaatactttagaaaaagatagtactaaaaacactgatgaagctttaattgaaatatatgaaaaacttcgtccaggagaaccagctacattagatagtgctaaaaatcaacttattacaagattctttgataagtttagatatgatttagcaaaggttggacgttataaatttaacaaaaagttaaacgttttagatcgcttacttggatgtgtaattgctcaagatattaaagacaatgatgaagttgttgtcgctagtggtactttaattactaaagatcttttagaaaaaattagaccattatttaacaatggatatggtttaaaagaaactattattaatgaagaattagatgaatacaataagattcaagaagtattagtttatgataaaactgataaagaaaaggttcacaaagttattggtaatgatcaaagcatagatgaaaaaagacttacaatttcagatgtatatgcttcagtatcatattatttaaatttgttatttaatattggtaatattgatgaaatcgatcatttaggaaatcgtcgtgttagacaagttggagaattaatacaaaatcaatttagagttggtatggctcgtatggaaagagttattcgtgaaagaatgactactcaagagattgaaaatgtaacccctaaaactttaataaatattcgtccagtaactgctgcattaaaagaattctttggttcatctcaattatctaaattcatggaccaaatcaatccaattgctgaattaactgataaaagacgtctatcatctttaggaccaggtggactatcacgtgatagagcaggtatggaagttcgtgacgttaacgcatctcattatggtcgtttatgtcctatcgaatctccagaaggccaaaatatcggtcttataacttcattatcaagttatgcgaaaatcaatgattatggattcataatgactccatatagaaaagtagaaaatgggcacgtaactgatgaagtagtttatttaactgctgatgaagaaaatgattattatatttctcaagctacaactccagtagatgatgataataatattagtgaaagccaagttattgcccgtttaaatggagatactgttatggttgacagcaaaaaagttaactatatcgatgttgctccatctcaagtagtttcaattactactagttgtattccattcttagatcacgatgatgcaactcgtgcattaatgggtgcaaacatgcaacgtcaagcagttccattattaaaaacagaagctccaattgtagctactggtgtagaatatattgctgcaagagattcaggatctacagtagttgctaaagctgatggtgtagtagaatatgctgattctaagaaaattgttgtaaaaaatgctaaaggtaaagatacttatttcttagctaattttgaaagaacaaatgcttcaacttgcttgaatcatcatccacttgttaaagctggtgacagtattcatagaggagaagttattgcagatggtccttctactgaaaaaggagaacttgctttaggtaaaaatatgacagtagcattcatgacatttaatggttataattatgaagatgctgtaatattaaatgaaagattagtaaaagatgatgtttatacatcattacatatagaacaaactgatatagattgtcgtgatactaaattaggaccagaggaaattactagagatattcctaacgtatctgaagaagcaagaaagaatcttgattctaatggtatagttcgtattggtaccgaagtacacgaaggcgacattttagttggtaaagttacaccaaaaggtgttcaagaattaactagtgaagaaaaattattacatgctatttttggtgaaaaaactagagaagttcgtgatacatcactacgtgttaaacacggtgaagatggtattgttcat

SEQ ID NO: 2558 - DNA, 1554 bp, Unknown
  Description of Unknown: Clostridiales sequence
atgggatttttaatgacacccatagtaactcttttgattggaatttttgcgggggctggtatttttggtttaattattataataagaaataattatatcgaaaacaaagctaataaatacttaaaagaagtaaaagaagaagctttacagcataaacgtgatacattacttgaactaaaagaagaatcatatcgtttaaaacaagaagctgaaaaagaaataaaagaaaaaaagcaagaattatctatcagtgaagataagttaatgcaaagagaatcatctttagatagacgtgaagaaatgcttcagaatagagattcaatgttagatcaaaaagataacaatttattagcaaaacaaaaagaattgcaagaaaaagaagttaaaatggatgaacttttaaaacaggaaatgcaagagttagaaaatattgctaagttttctaaagaaaaagcacatgatttaattatgaaacgtgttgaagaaactatgtctcatgaaattgctagttatgttaaagaagaagaagcaaaagctaaacttgaagctcatgaaaaagctaaacaaataatagtagaaagcatgcagagatattctaatgatgtttcaacagaacaaactgtaagtactattgatcttccaaatgatgatatgaaaggaagattaatcggacgtgaaggaagaaatattagaacgatagaagcagtaacaggtgtagatttaattattgatgatactcctgaaactattgttatttcatcatttgatcctttaagaagagaaattgctaaaataacaattgaaactcttattaaagatggaagaatacatccttctagaattgaagaagtctatgacaaggtttgccaagatatgaatactaagattactgaaataggtaatgaagctgtatttgaattaggactaacaaaactagatccggaattagttaatttaattggaaaattatattttagaactagttttggtcaaaatgctttacaacattctaaagaagttgcacatttaactggtttaatggcaagtgaattaaatgaaaatgttaatttagctaaaagagcaggattactgcatgatataggtaaagctatagattttgaaattgaaggttcgcatgtagaaataggagaaatgattgctaaaaaatatcatgaagatcctgttgtaattaatacaattatgtcacatcataacgactgtgatccaacatctactattgcagttttagttcaaattgccgatacattatctgctgcacgtcctggtgctagaaatgattcattagaaaattatataaaacgattagaacaattagaagaaattggtaattcttttgaaggtgtagataagacatatgcaatgcaagctggaagagaattaagagttatagttaaacctgatgaagtagatgataataaatcatataaaatagcaagagacataaaagaaaaaatagaaaatgaaatgcaatatcctggaacaattaaaataaatgttataagagaaactagagtgcaagaagaagcaaaatag

SEQ ID NO: 2559 - DNA, 1311 bp, Unknown
  Description of Unknown: Clostridiales sequence
atgaaaacaattaaaataaatgatttagaaaatcattatggtgaaaatgttttaattcaggggtttgtagaaaacattcgtaatttgcaatatgtaatatttttggttattaaggataatacaggaaaagttcaagttacgattgaaaaagaaaataatgatagcttagtaaatattgttgaaaaaataacattagaaagtacagttaaaattattggaacatgtaatgaagctgcatcagttaaacttggcggcaaggaaataattccaactgaggttattgttactagtagttctttagaagaattaccaattaatatcaaagataaatctgcagctttaagagaaacaagattagattatagatttttagatttaagaagagaagataataatctattatttaaaattgaaacattacttgaacattcgatgagagaatactgtattaacaataattttatggaaatacattctccaaaaatagcagcagctgctgcagaaagtggagcagaaacttttaaattagactactttggtcaagaagcttctttatcacaatctcctcaattttataaacaaatggcaatggcagcaaattttggtaaagtctttgaaataggacctgcttttagagcagaaaattcacatacttcttatcatgctactgaaataaatatggctgatgtagaaatgtcttggattgactcatttgaagatgttatggatatggaagaagaatggataaaatattcatttaaaaaagtttatgaaaaatatggagaacaaataaaaaaagaatttaaaactgatcttgtaaatcttgatgtaaagtttccaagagttacatttaaagaagcaaaacaaatattaaaagatgaatatcattttgaaggcgaaagagcagatgattttgaaagaaaagaagaaatgcttttatgtaaatatgctaagaaaaaatataatagtgatttcatttttgtaacgaagttcccatttgcggcccgtcctttttatcataatttagatgaagagggattaactaatagttatgatttattatttagaggagtagaaattacgacaggtgcccaaagagaacatagagtagatgttttaacaaagcaaataaaagtgaaagaaattgatccggcttcattagaattttatttagaattctttaaatatggttgtcctcctcatggtggatttgctattggtattgctcgtgttttgatgcaaatgttaaatattgataatataagagaagcgacatttatatatcgtggacctactagattaaaaccttaa

SEQ ID NO: 2560 - DNA, 1401 bp, Unknown
  Description of Unknown: Clostridiales sequence
gcaaaagaagtttatcaagtatatttagatggtaaaaaattgggagctatagcagatgctgatgaactatatacacttattaataaagaacaaagtgatataaaaagcacatataatgttgataatgtgtatccgccaaatggatttaatataactaaagatattacatatgaaaataatattgataatgtaaaaaaagtctatgatgaaataaaagaagaaaagccatttacaataaaaggatatgtaataacaataaaatataaagatgaaaataaaaaagatttaaaaattaatgttctagacaaaaaagtttttacagatgctataaacaatttaataacatcatttattcctagtgaaaaatatcaagcttacctaaaagatgaacaattagaaattgtagatactggttcattaatagaaagtgtttattttgatgaaactataacagctaaagaagcatatattggaactaaagaaaaaatatttactgatgaacaagaattaagtcaatatttaatgtttggaactaataatgctcaagaaaagtatattgttaatcaaggtgatactattgaaaaaatagcttataatcataagttaaatactgaagagtttttaatagctaaccctgaatttaaaagtgctgatagtttattatctattggccaagaagttaatatttccttaattaatccagttgtttctttaaattacgaaatgcatgtagttgaagatgctgatattgattttgaagtagaaacaacatatgattctagtaaacctacaacttatagtgaaactactcaagagggagtaaaaggaataaatagaattactaaaaaagtaaaatatacaaatggtgaagagaatcaaggcgcagttatcgtttcttatacaacaatcaaagaagcggtaaatcaaaaagtagttaaaggatctaaaagagtatcttctggtggtggatatatatctggtacttatgtagatactggagcagcatgggcatggccaacaaattcaccttatgtattaacaagtccatatggctatcgttggggaacattacatgatggtatggatatatctggtacaggatatggttcacctatttatgcagcacttgatggtgtagtcgttaatgctggatatggtggtatggttggttcatctgcaggatataatgtcgtattacaacatgataatggttattacactgtatatgcacatatgtcatcagttggtgtaacaaaaggacaaagagtaagtagaaaacaacgtctaggagcaatgggacaatctggaacagcaacaggtactcatcttcactttggagtatttattggaaaaccttatggtggtggacgttctataaatcctcttcagttgtggcaataa

SEQ ID NO: 2561 - DNA, 1632 bp, Unknown
  Description of Unknown: Clostridiales sequence
atgtcatataaagatttagctgattttatttttcctgatataaaacatgatattgcatattatgaagaaaaatatcctcaaagaaatttaaaagaaggctcaatagtaacaagatatgctccaagtccaactggatttgttcacataggagcattactagcttcctatactggctattcatttgcaaaacaaagtgatggtgtattttatttaagaatagaagatactgatactaaaagaactgtagaaaatggtgttagtaaaattataaaagaccttcaagattttaatataacatttggtgaaggaatgatagatgaacaagctgaaaaaggaaattatggaccttatattcagtcaagtagaaaagaaatttatcatacttttattaaatatttaatagctgaaaataaagcatatccttgttttttaactgaagaagaattaacagccatgagagaacgtcaagaaaaatataaagaaagaataggatgctatggtaagtatgccaaatatcgtgatgttgagccagaagaagctatagaaaaaatcaaaaatggtgaaccatatattataagattaaaatcaccagggagtttttataaaaaagtaaaatgtcatgatttaataagaggagaattagaattccctgaaaatgacttagatattcctatcatgaaaaaagatggcttacccacctatcattttgctcatttagtagatgatcatttaatgcgtacaactcatgtaattagaggagatgaatgggtagcctcactgccattgcatattcaactatttcaagtctttggttttaaagctccaaaatacgctcatatttctccattattaaaaaatgataatggaactattagaaagctaagtaaacgaaaagatccagaatgtgctgttagcttttatcatgaaatgggtattccaaatgaagcagtaaaactttatcttgctactataatcaatagtaattttgaagaatggtatttacaaaataaagataaatcaatagcagattttaaattcacttttaaaaaagttagtaaaagtggagccttatttgatttagaaaaattaggtaacatctcaaaaacctatttcagcagactaacaaaagatgaactttatgaacaagaagtaaaatatttagaagaattcgatcaagaatttttgcatgtgtttaccaagaattctgattattcaaaatcaattttaaatattgaaagagaaataaaaaagccaagaaaagatatagaaaaatatagtgatataaaaagattattttcatttatgtatgatgagacttttaaaccaacttggaatgaaaaagaaatagatattgaattaataagtgattatttaaataatatttatgctgaaaatgatgataaaaatacttggtttaataaaataaatgagtttgcattaaataatggctatacttctgtaaaagaatataaattaaatccagaaaattataaaggacatgttggagatatttgtgaaatgttaagatatgctatcacttcattaacacaaactccagatttatatgaaattatgcatattttaggaaaagagaaaatattaaatagagtagatatgtataaaaataaatag

SEQ ID NO: 2562 - DNA, 924 bp, Unknown
  Description of Unknown: Clostridiales sequence
tttaatccattagtaacatttttagaaaaaaatggttttaaacgagcgatagctgttgtaattgtttatttaggattcttatctataatatatttattcgttagtatgcttgttccaactgttattagccagtttaatgacttagtagctagtttaccatcaatatttaataaactaaaagatatagtagataatttctttagtggaataaataatattgatatttctacaatagctaaaattaaaactaaattatattctaatgtaggatcaatatttactggaatagtagagggattacctaatcaagcactcggctttttaagttcacttgtaagtggaataggaatatttgctattagtttaataatcggattttatatgttatttgactttggagctatccaaaaacattttataaaactaatacctaaaaaatatcgttatgaagcaagtggtttagttgatgaaatagctaaacaattaagaaaatatgttaatggtgttttaggagtagctagtatcatattagtaggttgttcagctggttttgctgtaattggtttaaaagcaccattactatttggtttattctgtggaataacagatttaattccatatattggaccatatattggaggaacagctgcagtaatagtcggattttctcaaagtcctacaataggtatattagcactgatagttatagtagttttccaagttttagaaagttatattatccaaccaatcgttatgagtaaaactatgaaattacatcctgtaacaatattaattggcttaactatttttggacatttctttggaatacctggtatggttcttgctacaccaattattgcattctttaaaataatatttaagtacgtaaataataaatttaacttaatagatatagatggttaa

SEQ ID NO: 2563 - DNA, 1128 bp, Unknown
  Description of Unknown: Clostridiales sequence
atgaaattagaatttgaattattgaaaactgaagaaaatactaaagcacgtcttggaaaaattaaatatcatggcaaagaatatgaaacaccaatgtttatgccagtaggtactttagcaacagttaaaacattatctccagaagaagtaaaagaagcccatgctggaattattttagctaatacctatcatttatggttaagaccaggagaagatattgtacataaagctggtggattacacaaatttatgaattatgatgggcctatgttaacagattcaggtggatatcaagtttttagtcttgctgatcctaaaaacataagtgaagagggagtaaaatttaaaaaccatttaaatggagatagtttattcttaactccagagaaatcaattgctattcaaaataaacttgatagtgatattgcaatgagttttgatgaatgccctccagcaagtgctagttatgaatatatgaaaaatagtattgaacgtactttgagatgggcaaaaagaggtaaggatgttcataataataagaatcaatgtttattcggaattgttcaaggtggagcatatgaagatttaagaaaattttctgctactgaaactgtaaaattagactttgatggttatagtattggtggcgttgctaatgatggtgaagataaagacagtatgtataaagctattgattattcaattccatatcttcctgaaaataaattacgttatttaatgggtgtaggagaacctatagatatcatagaaggtgttattagaggagttgatatatttgactgtgtttctccaactagattagctagacacggccatgctctaactaaatatggtaaaattaatatcagaaatagcaaatataaagaagatttttctaaattaactaatgattgtgattgttatgcatgtcaaaattatacaaaaagctatattcgccatttgataacttgcaatgaaacttttggagctagattactctcaattcataatataaggtttttaattaatttaacagaagaattaagagaggctataagaaataataatatattagaatataaagaaaaatttgtaaaaaattattataaaaaggataccaatgaataa

SEQ ID NO: 2564 - DNA, 1443 bp, Unknown
  Description of Unknown: Clostridiales sequence
atggataaagaaaaaccgaaaaagaaaaatagtaaattttttaaatttatttatttattactatttttatcttgtatattattttgtggagctatatattatttgaatttattaccatttaagtatttcattttagttgtagctgcagcagtatttattatctttttatttgccttagttttattaaatagaagagtgaagaaatttattaaatttttcttttcgatactagctataattattatgacaggtttatttttagtaagtaaatatagttttaatgttaaaggagttataaatgatgttactaaaaaaataaattataaaactgaaaattatgatgtaattgttttggataatagtaattatgaagatataaaagatttagaaaataaagaattaggatatttagataatggatctaatggaattaaaaaagctaaaagtacattaaaaaaacaagttaatacaagtaatgatgattatgatgatgttgctaagttatcaaatgatttattaaataaaaaaattgatgcaatattagtcgaagaaacttataaatcaattttagatgaagaatcagataaatttaaaagttcaactaaagtattatatgaatttagtgttaaaattcctgaagaaaaaaacagtaagaaagttgatgttacaaaagaaccatttaatgtttatataagtggaattgatacttatggaaagataacaagtgtttctagaagtgatgttaatattattgcaactgttaatcctcaaagtggacatgttttattgacttcagtaccaagagattattatgttcaattaagaggcactacaggtttaaaagataaacttactcatgctggtatatatggagtagaaaaatctgttggaactttagaagatttacttaatattaaaataaattattacttaaaagttaatttcacttcagttgttaagatagttgatacattaggaggcattacagtacattctgattataattttattagtcaagatggctttaaatatgtaaaaggtgataataaagtaaatggagaaagagctttatcttttgctagagaaagacattcatttaatagtggagatattcaacgtggtaagaatcagatgtacgttatacaaggtatggctgatgaattaatgagtttttcttcagtaactaagtttaattctttattaagtgacttagatggaacttttgaaactaatataagcagtgatgaaatatctaaattagtaaagatgcaaatagataagaatattaattggaatattgaaaataatactttagatggaactggtgctaagaaagcaacatatactgctaagtcaactaaagcatatgttatggaaccagatgtggcatcagtagcttcagcaaccactaaaatagaaaaagtaatgcatgaaaaaaattaa

SEQ ID NO: 2565 - DNA, 612 bp, Unknown
  Description of Unknown: Clostridiales sequence
atgaagtgtgatttattagaaaaactagatataatgattcctgatcctaaatgtgagcttaattataataaggattatgaattattaattgctactgttttgagtgctcaatgtactgatgctcgagtaaatatggttactaaagaattgtttagcaaatatgatatctatagtttagcagcagcaaatattaatgatataaaaaagattattaagtctgttggaacttatactagaaaaagtgaatacattatagaaattgctaaaagattagttaatgattataatggaaaagtacctaatgatagaaaatacttagaaagtttaccaggagtagggcgaaaaacttgcaatgttgttctttctaatatttatgatgtaccaactattgctgtagatactcatgtggagcgtgtttcaaaaagattaaatttggttagacaaaatgatgacgtaataaaagtagaaaataaattaatgaaaaagattcctaaaaataaatggagtaggtttcatcatcaaatggtgttatttgggagatatatttgtaaaagtaaaaatcctgattgtgagaattgtttattaaataatgagtgtaaatattatttgaga

SEQ ID NO: 2566 - DNA, 894 bp, Unknown
  Description of Unknown: Clostridiales sequence
gtaaatgatattttatataatgctttaactaaaaaaatatataattctaaaacaatagtaggaaaatgtaaagatataaaaggtattgaaaacattgataaagtaattcacataagtcaggatccaattggaagaacaccaagaagtaacccggcaacatatgttggagtatttgatgatattcgtgatgtttttgctaacactaaagaagctaaaatgcatggatacggaaaaaacagattttcttttaatgtaaaaggtggaagatgtgaagcttgttacggtgatggtgtaaaaagaattgaaatgaattttttaccagatgtttatgtgccttgtgaagtgtgtcatggaacgcgctataataaagaaacgttagatataaaatttaaaggtaaaaatattagtgacgttttaaaaatgagagttagtgaagcaattgaattttttgaaaatatccctaaagttaaaaagaaattacaagtaatgatggatgttggactttcatacatagaacttggtcaatctgctcctacgctatcagggggcgaagccggcagagtaaaacttgcaaaagaattacaaaagaaagctactggtaaaagtgtatttattcttgatgaaccaacaacaggattacatagtcacgatataaaaaaattattaacaattttgcaaagaatagtagataatggtgacacagtaatcgtaatagaacataacttagatgttataaaggtcgcagatcatataattgatttaggaccagaaggtggcgaaggcggtggacaaatcattgctagtggcactccagaagctatttgcaaagtaaaagaatcatacactggacaatatttaaaaaagtatatgattgaaaaaaataatcatgtttag

SEQ ID NO: 2567 - DNA, 795 bp, Unknown
  Description of Unknown: Clostridiales sequence
tcagatatgaaggaagatttgcatgctaaattagaagatgaagatatagaaaatgatattaaattaagaataaaaaatatttataacgtatatgtttctttaagtaaaggcagagatatggataatattcatgatctatttgctttgcagattggcttaaatagaatacctgattgttatttggcttttggagtaattcatcaaaattatccaacttatttacaagaaaagtttaaagattatatttttaaatgtaaaactactggttatagagcacttcatactacaattgtagataaagatcaacaaatgattcaagctcagattcgtactaaagatatggcttggaaaaatacaagaggaataattggaaatttgaaagattataatttaacagaatttgctaatattaaaaaacagtatccctttttctctatttgtgaagagatagataaagttactaataataatgattttgatttttatgataaactaagttatgaaatattaggagataaaatatatgtaactagtgaaaaaagtggtaaatgtattcaacttccatttggagcaactgttttagactatgcttttgatgcctgctctaatagggcaaaaagagcagttcaaggagttgttaacggcaaaaaagtaagtttagattacaaattaaaaaatggtgatcgtgttacgtttacaagtgatgaagaaaatacaatagatgaatcttggataaatgaatgtgcaacaactcatggtaaaagactaattaaagaaaatttaaaaaggagctga

SEQ ID NO: 2568 - DNA, 1764 bp, Unknown
  Description of Unknown: Clostridiales sequence
atgaaagaaaagagaagtattattatgagtaaaattaaagtaatgagtgatatcttagccaataaaatagcagctggtgaagttgtagaaaaatgtgcttcagttgttaaagaattagttgaaaatagtatagatgcagatgccactgatattaaaattgaattaattgattctggaataaaaagtattaaggttactgataatggtaatggtatggatagtgaggatgcattacttgctttttctagacacgctacaagtaagttattaaaggaagacgatttattttttattgatactttaggttttagaggtgaagccttaccttctatagccagtgtttctaaggttactttaatgacttcaactaatgaagtaggaacacaaatcaaaattgaaggcggtaagttaatttctaatgagaaatgtgcttttaacaaaggaacaagtattgaagtatcggcacttttttataatacaccagcaagattaaaatatttaaagagtgaaactacggagttagcaaatactactagttttattgaaaaattaagttttgcttatccaaatataagattcactttaataaataatgataaagtaatagtaaaaactagtggaagtaatgatttattaaaaactatacatgaagtttttggaatgcaaatatcatctaatatgttagaaataaaaaatagtaatgatgattttgatatttatggttatgtttgcaaacctcagatattaaaatcaaaccgtagtcatatgataactattgttaatcaaagggtagtaagaaataatgatttaaatagagctataaatgacgcttattatacttataaaccagatattaaatatcctgttgtagttttaataataaatactgatcctacattaatcgatgtaaatattcatcctactaaacaagatataaaaataagtaaaatgcaagaattaaataatttattgattaatacaattaaagatgcattatataaaaatttacttatacctaaaatagaagttacgccaactactaatgatgttaaagaagaatttgttaataattttatagctaaagaagaaactcctatagtaaaagatgaacaggcagtatttgatttaggagtggaagaaaatgttaatgatacagttgttataaatgaagaattaaagtctttaaaattgtatccagtgggacttgcattaggaacttatattattgcccaaaatgatgaaggtgtttatttaatagatcagcatgcagctgaagaaagaattaactatgaaaaatatttgaaagcattaataaatgaagaaatttctactacatctttattatttccaataagtattgagctttcaccaagtgattttataataattaaggaaaatatggaagttttaactaatatgggttttaaagtagaagagtttggagttaatactattttaataaaagaacatcctacatggttaaaaaaaggttttgaggaagaacaaataagaaaaataatagatttagttattgtaaataaaaataagtttacaagagttaaattcaatgaacatatagctatcacgttagcttgtaaaactagtattaaaggtaatactaatattagtatggattcaattgaggaaatattaaattctttggtaaaatgtgataatccatataattgtcctcatggaagacctacaataataaaatttagtatctatgagttagaaagaatgtttaaaagggtaatgaattaa

SEQ ID NO: 2569 - DNA, 993 bp, Unknown
  Description of Unknown: Clostridiales sequence
atgaaatttaaaataggcaatgttgaaattaaaaaccaagtagtactcgcaccaatggcgggtattactaacacttcatatcgtaaaataataaaagaaatgcaagctggtttaatttatgctgaaatggtcagtgataaagcgttagtttactctaatgaaaaaacttttgacttattaaaaatgactgatgcagaacgtcctattgctcaacagatatttggcagtgatatagagtcctttgttaaagcagcaaaaatagtagaagatactatgcacccagatattatagatataaatatgggatgtccagtaccaaaagttgctttaaaaaatcaagctggaagtgcgcttttaaaaaatcctcaaaaaataaaagaaatagtttcagcagtagtaaaaactgtaaacgtaccagttacggtaaaaataagaagcggctgggatgaaaattcaataaatgcagtagaagtagcaaaaatagtagaagcagctggagcaagtgctatagctgtccatgctcgaactagatcccaaggttatagtggaaaagctgattggaatataataaaacaggtaaaagaagctgttaatattcctgttataggaaatggtgatgtgactagttgttttttagctaagaagatgcttgaagaaactaagtgtgatgcagtaatgataggtagaggagtattaggcaacccttggttaacaaaagaatgtgttgaatatttagaaacaaataaattaccagaaaaagtaactaatacagaaaaaattaatatgatgaaaagacattacaatcttttgttagaagataaatgtgaaaaattagctaatttagaaataagaagtcatatattatattatttgaaaggaatgcctagaaataaagaaataaaaaatcaaatttgccaatgtaaaaacaaaaatgaattaataagtactttagataattatgaaaaatatttaaaagaagagggtttagaatga

SEQ ID NO: 2570 - DNA, 1290 bp, Unknown
  Description of Unknown: Clostridiales sequence
atggatgtaaatataattacatttggatgtaaagtaaatacttatgaaagtgaaataataaaagaaaaatttttagaaaaaaaatttaatattgttgatgattataaaatagctgatgtcgtagtagtaaatacatgtagtgttactaataatgcagataataaatcaaagaagtctataagagatattaaaagagataatccatcatgtattttagtagtatgtggatgtatgagccagaatcatcaagtagatttagaatgcttaggaatagatatattaataggaaatcaagataaaagtaaaatagtagagttagttttaaattataaaatgaatcatgaaaaatatattaatttttctaatatgcaagatttagattttgaagatatgcaaattaaaaaatttacgggtcaaactagagcatttataaaaatacaggatgggtgtaataactattgttcttattgtattattccttacatgcgtggtaatttaagatgcaaagattttgataaagctataaacgaagcccaagaacttgctaaatatcatcaagaaattgtattaactggtattcacaccggaacttataatagcaatggtaaagatttagtagatctaataaatgaaatgagcaaaatagaaaatattaaaagaattagaatatcatctatagaaatattagaaataactgaaaagttcttggatatgctaaaaaataatcctaaagtatgtaatcacttacatattcctttgcaatcgggtagtaatactatattaaaattaatgaatcgtcgttatttaaaagaaaaatttttagaaattgtaaatcaaataagagctgtaagaccagatattagtttgactactgatttaatcgtaggttttcctggagaaactgaagaattatttaaagaatctaaagagttttgtaaactaattaattttagtaaaattcatgtctttcctttttctttaagaagtaatactaaagcagagaaattacctaatcatatagataataaaactaaaaaagaaagagtccatgaaatgctaaaattgtctttagaattagaagaaaaatattatgaaaagtttattaatcaagatatggaagtattaattgaacaatatgatggcaaatatagtattggtcatacatctaattatctgaaagtaaaaattgctcaacaattagaaaataatcaattttataacgtaaaaataacaaaaatatgtcaaaatgatgtttatggagctttaaatgattgcttaattcattcttaa

SEQ ID NO: 2571 - DNA, 1458 bp, Unknown
  Description of Unknown: Clostridiales sequence
aaacataatataaacattgctaattgccaatttgatactatgatagcttcttctttattatatgataatctaaaagaagatattgcttattatatgaataataaaaatgttgatgttcctttttatgaaaatttaaaaaaaggtaatttttctatagatgtattagaaaaaactacacctttaaaagctagatttatttatgatactcatgatgaattagtaaatgaacttgaaaacaatcagatgttagatttatttattaaaactgaaatgcctttatcaaaagttttagctaaaatggaattagaaggtgttaaagtaaatttagatgttttactagcaatgaaaaaagaagtccaagaaaaaatagacataatatcagatgaaatatatgaaatggcaggaaaaacatttaatatttcttctccaaaacagcttggtgaagtattatttgatgatttaggtttaccatttggtaagagaaatgttaaaggatataaaactgatataaaggttttacataaattggtagatcatcatccaattattaataaaatcatggaatatcgtaatttaactaaattaatgaatacatatattgatggtcttcctaattttattttagaagatggtaaaatacatacaatttatacacaaactttaactagaacaggacgtttgtcatcaattctgcctaatttacagaatattccgacacgtgatcaagaaggtaaaaaaattagaaaagcatttataccagtaaatgatttattcttaagtgcagattattctcaaatagaattgcgtttacttgctcatatttcaggttctaaagaattacaagaagcttttattaatggtcaagatattcataagaaagtagctgctgatatatttggggtagaagaaaaggatgtttctaaagaaatgcgttctactgctaaagctgttatctttggtatagtttatgggattagtggttttggtttaggagaaaatttaagtattaatgctaaagaagcaaaaacatttatagataagtatttagaactttatccaggtgtaaaaaaatatatggataatatagttaaagaagcatatgaaaagggatatgtaaaaactttatttgatcgtaaaagaaatatagatgaattaaaatcaaaagtttatcaagttcgtagtgctggtgaaagaatagctttaaatactccaattcaaggaactagtgctgatataattaaaatggcgatggttaaaattgatcgtgaatttactagactaaacataaaaagtaaaatgattttacaagttcatgatgaattgatttttgatataaaattagaagaaaaagaacaagttgaaagtattgttaaagatataatggaaaacattgttattttatcagttccattaaaagctagtgcagattatggtactgattggtatgaaacgaaataa

SEQ ID NO: 2572 - DNA, 1230 bp, Unknown
  Description of Unknown: Clostridiales sequence
atgacaaatattttaactaaaaaaagactgtatttaaataatataaaatgtaccataaatgaattaaaatcatatattaatcatttaccatcaaactcaaaaactataatgggaatgtattttggtttagaaaatactttagaaaagcctttagaagaattagaaaaagattatagtttttctaatattgcagttgctacaaatagtactaaagaagaagttgaacaaataactaaagaatatataaaagttttgcaaaacagccatccaaaatttactaatttagataaagttgactttaaaatagaagaatttgtatattctgttaaaaatgaagaagaaatatatgtttctcaaatggatgatacaatttttttaatagagaattacattgaaaattataacttgaaagaaatatatataaacaaattatatcttttattaaatcaagcaaatattagaattaatcctaatcgatatagtcaaaaaagggaaagagaattaattagtatatatcaaaaaaataaagatgaaaaagccttaacagaattaattgacatgcataaaaaattattacataaaatggctaaaggttattacacaattagttcttcatttgaagatgtatatcaagaagttttaattggatttattaaaggagtaaaaacatttgatttaagctatgattatagattgatgactcatgctaaatggcatattatgcataatatgagaaatgattttaagactaatgatcaaataataagagttccttcaaatacttatgataaattaataaaaataagaagaagtaaatcagaattatttagattactaaatagagaaccaacagtaaaagaattatcaaattcaactggactacctgaaaatgttattaaagaaatattggattttaattatgaaataatttctttaagtacatttattaatgaaaaagaagaggggatagaaaaaattattccaagtagtttagtaaatattgaacaagaggcaattgataatgcttttaaacaagaattattaaataaaattaatactttaaatgattcagaaaaaaaggtattgataaaaaaatatggatttgatgaaagaggagaaaagacttactctgaagttggtagagaattaaatctatctcgccaaagggtacatcaaatagagcagaaagctttatcaaaattaagcactgatgcaagtttaaaaaaatag

SEQ ID NO: 2573 - DNA, 762 bp, Unknown
  Description of Unknown: Clostridiales sequence
atgaaaaaagaaaatatgattgaagttaaaaatgtttcaatgaagtttaatttaggaattgaaaaaaatttttctttaaaacaattttttgttgatttctttagtttaaaaaggagaaaagaaaaaaagaaaaaaaatcctgagttttgggctttgaaaaatttaaacattgatataaaaactggtgaagtagttggatttgttggtagtaatggtgctggtaaatcaactctattaaaagtagttgcaggagttatgaaaccaactaaaggtaaagttaatgcttatggtaatatttgccctatgatagaattaggtgctggatttgatccggatttaactgctagagagaatatttatttaaatggagcagtaatggggtatagccaagaattattagattctaaatttcaagaaattgttgattttagtgaacttcatgatttcttagatgtaccagttaaaaatttttcttctggtatggttgctagacttgctttttctgttgcaactattgttgatccagaaatattgattgttgatgaaattttatctgttggagatatagcttttcaagctaaatctgaaaataaaatgaaaagcatgattaatggcggaactacagttttatatgtatcgcattctattgaatcgataaaaaaactatgtgatagagttatttggctagatcatggtgaagttcaaatgattggtggaaaagaagtttgcgataaatatttagaatttatgatggaaaagtag

SEQ ID NO: 2574 - DNA, 885 bp, Unknown
  Description of Unknown: Clostridiales sequence
atgaaaagtggttttgttagtttaataggtagaccaaatgttggtaaaagtacgttactaaattgtttagttaatgctcatgttgcaattacatcaaataaacctcaaactacaagaaatattattcaaggggtttataatgaaaaagatttacaaattgtttttgttgatacgccaggaatccataaaccaattcataaacttggtaaaactttaaataaacaagcaatttcgttatcaaaagatgttgatgttatattatttttagctgatgctagtgaatatttaggcaatggagataaatatgtcatgaatatgttaaagtctacagatattcctgtaatattagttttaaataaaatagataaactctcaaatgaacaaatattacttaaaataaaggaatataaagatgaatatccatttgcagaaatagttccagtctctgctttaaaaaatgataatactaatcgtttactagaagttataaaaaaatatttaactgatgatatgaagtattttgaagatgattatttaactagtaacagcttaagttttatggttagcgaatttgttagagaaaaaatactaaatttaactgaagaagaagtacctcatagcataacttgtttaactacagaatttgaagaaaaagaaaatatagtaaatatagctgtagatatcatagtggatagagcatcattaaaaaaaataattataggttctcaaggttcaatgcttaaacaaattggaactttagcaagaaaagatatcgaaactttattaaataaaaaagtttatttagaactatttgttaaagttatacctaattggagagataaagaaagatatataaaagaattaggatttaaagattttgaataa

SEQ ID NO: 2575 - DNA, 672 bp, Unknown
  Description of Unknown: Clostridiales sequence
atgaaaaaaatttttgttgaatataatgcttatttaagtgatttatataagagagaagaaaatgttggaaagagtgaaaaagaacttatactagaaaataaattatatgaaagagcttatactgtaactaagtgtggacctagaagtcgtcaaaagttaaatttagattacacaccttactatgtaaaacctgttcttagtttacatggtaataaattaagtgatatagcttattttaatgatgattgtatcggaattttagttaatgaaaatgaattggaaacattaaatgtaccatttagttcagtgtatattttagaacaatctatggttagaggagctttttataaaagaactgttgacaatatttatttaatggagtcattagataatgaagagcttaacacattaagtaaagaagaatctgcttattataataattttgttaataagcctaagtttgctaaagaagttaatgaggatggaactatttcacttgttgcattacatgatgaaaatagtaatttaaaaaaatatgttgaatgtgatgaaaattatcctgaaagtatggctgaattaattagttatttaaaagttaattctaaagaaaattttgttgcagaagacttacctttaagagctaaaaaacatagaagattacttaaaagataa

SEQ ID NO: 2576 - DNA, 1413 bp, Oscillibacter sp.
atgaacctgcacaagatccgggaggccgccgaaaagcacacctcccgccgcggcgcgttttccgccgcggtcaccgcgctggccgtggcagtggtgctcctcatcaatttgctggcagcccagctgccggagcactggacccaattcgatctcaccgacagcggtatttacgacatctccgccaccacccgggactacatggcggacctggaggaggatgtggtgatccacgttctggcggaccaggacagcctggacacccgcatcgtccgcttcctggccacctatgaagagctcagcagccacctgagcgtggagtataccaaccccatggtgtatccctccgttctcacggactacggtgtggacagcaataccatcgtggtcacctgcgaggccaccggccgtcaggagagcttttcgattgacgacatcatcggatatgatataatgtcttattattactacggttcttataatgagacggattttgacggcgagggacttctgacctccgctgtggacggcgtcctgaccggcgcctcccgcaccatttgccagaccaccggccatgacgaggcggctctctccagcacggtagagacgctgctgtccaaatcccacatctctgtttccagcgtgaacctgctgacggaccacagcatccccgaggactgtgacctgctgctcatcaacgatcccacccgggatctggcggcggacgaactggaggacattctggaatacctcgccgccggcggccaggtgatctataacatggcgggggaggatctgtccctgcccaacctggagacgctctgtgccacctacggcatggatgtggcgccgggcctcatcgccgatacccagcggtattatcagaataatccctactggttcttccccctggtggacaacagcgtggattctgccagcggcatttccaacgatgccacgcttctcttctgcgcgtcccggggcttcaccctgacggatcccgcccgggagagcattaccgtcaagtccttcctcaccacctccgaggagggcatggccgttaccggcgactcggcgaaagaccagacccccggcacctacgtggtggctgccacagccacggaggagatcgacgacgggatcaccggacggctgacggtgttcggctccgactccctcatcaacgacgccatcaactccaccttcaccaatctggataacctgaccctcttcaccagcgcagtcaccgtggacttcgacggcatctcctcgctctccattgagccggtgagtctggagacccccaccaataccatctccaccggaggcatctgggcactgctgctgatcttcctgatccccggtgcccttttgatctacggcttcatccgctggctgcgccgacaaaaactctaa

SEQ ID NO: 2577 - DNA, 1749 bp, Oscillibacter sp.
atggatattttttccgtcttcacactctgcggaggactggccttcttcctatacggaatgaacaccatgtccaagagcctggagaaaatggccggcggcaagctggagcggctgctcaagcgcatgacctccaaccctgtcaagagccttctgctgggcgccggcatcaccatcgccatccagtcctcatccgccatgaccgtgatgctggtgggccttgtgaactccggcgtcatggagctgggccagaccatcggtgtcatcatgggctccaacatcggcaccaccctcaccgcgtggatcctctccctcaccggcatccagagcgagagcatcttcgtgaacatgctcaagccggagaacttttcgcccctggtggccctggcgggcatcatcctcatcatgggatccaaacggcaaaagcgccgggatgtgggccgcatcatggtgggcttttccattttgatgtacggcatggaactcatgagcgacgctgtcagtcccctggcggatatgccggaattttccagcctgctcaccgctttccagaatccgctgctgggcgtgctggtgggtgccgtgtttaccggcatcatccagtcctccgccgcgtccgtgggcattttgcaggctctggcgctgaccggttccatcacctacggcatggccatccccatcatcatgggccagaatatcggcacctgcgtcaccgcgctgctcagctccatcggcgtcaaccgcaatgccaagcgggtggcggtgatccacatctcctttaacgtcatcggcacagtcgtgtgcctggtgctcttctacggcggcaatctgatcttcgacttctccttcatggactggacggtgggtgccgtgggcatcgccttctgccacaccgtattcaatctcttcaccaccctgatgctcctgccgttctcccgccagctggaaaagctggcgcggagactcatccgcacggaaaaccccgccaaggagtttgccttcctggatcccctgctgatccgcacccccagcgtggccatcagcgaatgtgtgtctatggcctgccggatgggagaaaccgcccgggacaatgtgctgctggcaatggagcagctctccggcttcagtgaggagcgggaggcccagatcctggaaaatgaggacaagctggacacttatgaggaccggctgggcagctatctggtggacgtctcccagcacggcgtgtccatggtggacatccgtacggtctcccgcctgctccacgccatcggcgacttcgagcgcatcggcgaccacgccatcaacatccaggattccgcccgggaactgcatgagaaggaactccggttctctcccactgccgaaaaggaacttcaggtgctgggaacagcactggaggacatcctcttccaggccgtctccagtttcaaccaggatgatccggcggccgccaaggcggtggagcccctggaggaaaccatcgaccagctcaccgaggagatccgcatgcgccatatccagcgcctccagaccggtgagtgcaccatccagctgggctttgtgctcaacgacctgctgaccaacctggagcgggtgtccgaccactgctccaacatcgccgtgtgcgtcatcgaggagcgggacagctccgtggaccatcacgcctatctccaccggctgaaggtggatgacaattttgctgaggaattgcgggaggatctgagcaagtaccgcctgcccaatgcctga

SEQ ID NO: 2578 - DNA, 1386 bp, Oscillibacter sp.
atgttcgagcatcaggacacgcagacggatttattggagcagatcgaagatctgattcatgaaaagcgatatgctcagctgcgggatcttctggttcctatggaagcgcccgacatcgcacagctgtgcgcggatctggatgagaagacattgcctctggtgtttcgcctgctgcccaaggagcaggccgcggaggtattcgtggagctggacagcgaccagcaggagatgctgatccagggcttttccaacacaaagctcaaggaagtgctggacgagctgtatctggacgatacggtcgacatcgtcgaggagatgcctgccaatgtggtcaagcggatcctgcgccactccgatccggagacccgaaaaagcatcaatgaaattctcaagtatcccgacgactccaccggcagcatcatgaccacggagtttgtggacttgaaagccaccatgacggtggaggacgccctcaagcgcatccgccggaccggtcccgataaagagaccattaacatctgctacgtgatcgacgatcagcgccatcttctgggacttttgtccatccgcacgctgctgctggcggaggacgacgacatcatcgacgacatcatggagcaccacatcatctctgtccacacattggatgaccaggaatccactgcccgggtcctgagcaagtatgattttctggccctgccagtagtggacacggaaaaccgcctggtgggcatcgtcaccgtagacgacgccatggacgttctgcaggaagaggtcacggaggacatcgaattgatggccgctatcctgcccggcgacaagccctatctcaaaaccggcgttctggagacctggaaggcccggacaccatggctgctggtgctgatgctctcggccacctttaccggcatcatcctgacccactttgaaaacgcactggccgcctgtgctatcctgacctcctttatccccatgctctccggtaccggcggcaacagcggcacccaggcctccacagctgtgatccgtgccctgtctttgggtgagcttcgcttttccgaccttccccgggtcatctggaaggaattccgggtctccatcacctgcggtctgtgccttgcggcggccaacttcgtgaaaatgatggtggtggatcgctggctgatgcataatcctgccgtcacgccgctggtggcactggtggtgtgtaccacgctggtcggcaccgtgatgtgcgccaagctggtgggctgctcgctgccgctgctggccaaaaagctccactttgatccggcggtcatggcctcccccttcatctccaccatcgtggactcgctgtcgctgctgatctatttccgctttgcgtcgctgtttttgggactgtga

SEQ ID NO: 2579 - DNA, 2226 bp, Oscillibacter sp.
atgaaccccaaagatacacgctcccttcgcctgtatgtgctggcaggtcttttgactctggtgctgctggtgttcgcaggcattttgtacaacacgcagatcgtcaaccacgattactacgtggcccagtccatccgcaccatcgcccgggaggagaaggtggaggcctcccggggcgtcatcaccgaccgcagcggccaggtgatggtctccagccgctccacatacagcctcacctttgactccagcctcctcaaggacggcgaggaccccaacgaggccattttgcggctggtccagctgtgccaggccaacggtgtcgcctggaacgacaatctgcccatctcccagcaggccccctacacctataccctggactccatgacggacatcctcaactcccgctttttgaagtacgtcaagtccctcaagcccgccagcgaggccctgggcaattacctgctggagcacccggagatcgtgggcgagagcgccgactccatccccacccttccctcggaggtggaccaggatgacgccgaggctgtggaggccgccaggaaagaggccaaggatcgcgctgaggagcttttggatctgctgaccacggagcagctctccgcccagttgctcacggacgccggcatctccccggagacgctgatggactggatgcgggaagacctggaggtccccgaatcctttacccaggcggaggcccgcatggtgctgggcatccagtatgagctctccgtccggaaagtggtcagcaccaccgcctatgtgatggcggaggacatctccaccggtttcatttcgctgctggcggacggccagtacagcggtgccaaggtcaccgcctcttctgtgcgggaatactccaccacttacgccgcccagatcctgggccgggtcacccagatctatgccaccgacgaagcctatcaggacggcagcctgatggaacagggctacgacatggatgacaagatcggccgctccggcgtggagaaggcctttgaggagtacctccggggcaccgacggcacccgcgtggtctccaccaactccgccggcaaggtcaccggcgagttctattccaagcagccccagcccggcaacaccgtggagctgacgctggacctggacctgcagcaggcggtggaggaaaatctggcggccaccgtggcgcagatgaacgccgaggacggggacgacacccggggcgccggctgcgccatcgtgaaggtgggcaccggtgagatcctggccctggcctcctatcccacctttgatccctccacgtacagcaccaattacgcggagatctccaataatccggcccggccggaatacaaccgggccacccagggcacctacgcccccggctccaccctcaagcccctcaccgccgtggcggcgctggagaccggcaacgtgacgctgacggaaaagatcaacgacaccggcaagtggacctatcccggctctccccagagctacacctactgctgggaccgcagcggccacggccttctgaacgtgacggaggccatcaccaactcctgcaactacttctttgccaccatgggctaccgcatgggcatggataccctggtggagtacctgaaggccttcggcctggggtcccacaccggcatcgagatcggcgacagcaccggcacgctgccggagaaccctcccggtgaggaccaggctccctgggccgccttcggccagtccagccaggcctataccccgctccagctggccaactacatcgccacgctggtctccggcggcgagcactgcgacgcccatctgctcaaggccgtcaagtcctatgacaactccgaagttctgaaagtgggcgacagctccgccaaaaacaccgtctccatcaaggattctacgctggaggcagtcaaggaaggcatgctgggctacacccagcccagcggccagctgtacagctacttccgcaactgtgtggtgaaggccggtgccaagaccggtaccgcccagctgggcggcggccagaccaacaacggcgtttttgtctgcttcgccccctacgacgatccggagatcgccctggccatggtcattgagcacggcaacgccggtgccgccctggcctccaccgccgtcaacatcctcaacgcctatttctccgccgatgacatcggcaccgccgtgatcggcgaaaatcagctgctgcagtaa

SEQ ID NO: 2580 - DNA, 1368 bp, Oscillibacter sp.
atggttaagaacctgacggaaggacagcccctgcggctgctgttcttcttttccctgcccatggtggcgggaaacctctttcagcagctctacaacatggtggataccgccgtggtgggcaaattcgtaggcgaggacgccgtggccgccgtgggctcctccttccccatcgtctttttgtccgtggcggtggccgccggtctctctatgggctgcaacgtggtggtctcccagctcttcggcgccgggcgcatccacgagatgaaatccaccatctccaccgccatcatctctttgagcgtgctgggactgatcctgatggcgctgggcaccatttctgccggaccgctgctggagctgctgggcacggacccggacatcatggccgattcccagacctatctgcggatctatttcggcggtgccgtgttcctcttcctctacaacaccctcaacggcatttacaatgcccagggcgacagcaaaacacctttgatcttcctcatgatctccagcctgaccaacatcgtactggatctgctgttcgtcatccggttccacatgggcgtggccggcgtggcctgggccacgctgattgcccagggcatctgcgccgtggcgtctctcgcggtgctcttcctgcggatgaagcgcctgccctgcgaggccggcaaagagggggaaaagatcccgctcttccacaagatcgccgtcaagcgcatcgcccagatcggtctgccctccatgctgcagcagtctttggtgtccctctccatgatgatgatgcagggcctggtcaattcctacggcaaggtgctggtggccggctacaccgccgccaccaagatcgacacgctggccatgctgcccaacctgaacttctccaacgccatgtccagctacaccgcccagaatatcggcgccggacgctatgaccgggtcaagcagggcctgaaggccagccttttcatggtggtggtgttctccctgctcatcaccgtcatcatcttcctcttcggcgaccagctgctctccctgttcctagatcccggcgacacctccggtgctctgggctgcggtctgacgtacatgcacaccgtctccctgttctatatcctgatgggactgctcttcgtctccaacggcatgctccggggctccggcgacatgggcgccttcaccctcagttccatggccaacctcttctctcgggtggcggtggcctatgccctggcgtatctcacgcctctgggcgccaatgccatctggtggtccatccccgccggctgggccatcggctctgtggtgtccttgctgcgggtcaaaagcggcaagtggatgcgccaagcggtaagtgagcgcatttga

SEQ ID NO: 2581 - DNA, 1722 bp, Oscillibacter sp.
atgatgcagaaaagtcatgacgatcggatgctgtgggcgcagttcgattccctggaaatgggcacgggctgggacgacacggacatcgaaaagccccagatcatggtggagagcgtgtacggcgactctcaccccggcagctggcacctgaaccagctggtggagcaggcggtgtacggcgtgtacgaaaagggcggcaagcctgccaagtactatgccacggacatctgcgacggctgcgcccagggccatgacggcatgaacgtggtgctggcttcccgtgaggcgctggccaacatggtggaggtccacgcctccgcagtgccctgggacggcatgatcctgacgtccagctgcgacaagtccattcccgcccacctgaaggctgcggcccggatggacatccccaccatcttcatgcccggcggctccatgcggcccggccccaacatgaccacgtccctggtggccggcgacatctccctgcgtcagaagcgcaaggacgccatcacgccccaggaagtgcgggattataagctgaccggctgcccgtccgtgggcgcgtgcaccttcctgggcaccgcatccaccatgcagtgcatcgccgaggctctgggcatgacgctgcccggcgcggctctggctcccgccaccatgcgggacatcatccagtacgcccgctatgccggccggaagatcatggagttggtggagaaggacatcaccgccagcaagatcatgacccccgcggcgttcaagaacgccatcatcgtccacagcgccatcggtggctccaccaacgccaccatccatctgccctccatcgcccgggagctgggctatgacctgcccatcgagctcttcgacgagatcaaccatcaggtgccccacctgggcaacatcttcccctccggcgcccagctgacggagtccttctggttcgccggcggcatccccatggtgcagtggatgctgcgggatatgctggatctggacgtgatgaccgtcaccggcaagaccctgggcgagaacctggaggacctgcacaaggacaactggttcgaccggaacctgggctaccttgccaactacggcctgacccgcgaccaggtgatcttcccggtggagaaggctcccgagaagggctctgtggccatcctgaagggcaacatcgctcccgagggctctgtgctcaagtactccgcctgcgccatgaaccagcgggaagtggtcaacgccaaggcccgggtgttcaaccacgaggaggacgcccacgatgccgtggtgaacaatgagatcaatcccggcgaagtcgtcatcatccgctatgagggcccccgcggctgcggtatgcccgagatgctgatgaccaccgaggccatctgctgcgacgagcggatcaacggctccgtggcactgatcaccgacggccggttctccggtgccacccgcggcgccgccatcggccatgtcagccccgaggctgctgccggcggccccatcgcattcctggaggacggcgacctgatctcttacagcgtggagaaccgtaccatcaacatgacgggtatccacggcgtgccctgcacggtggaagaggctacggcagagctggccaagcgcgctgagaagggcatcctgccccgcgagaagcgcaagggcttctataagctctacaccgatcgtgccctctctgccatgaagggcgccggcctggaataa

SEQ ID NO: 2582 - DNA, 3573 bp, Oscillibacter sp.
atgaaaggtatgtggaaaaaacgcctgtcagcatttttgctgactctggctctgacagcaagcctgatccccgccgccgcggctgaggagcaccattatgcctcggcctggtccagcgacggatcctatcactggcacgtctgcaccgatcaggactgtgacgcccggggagactatgagccccacgacttcggcgccaccgtcaccaccaagtcccccacctgcttccagcccggtgaggggtatcaggagtgcaccgtgtgcaagtacaaaaagacggtgtccatccccgccaccaacgcccacaaggcggcttccggctggacctgggacaccgccaagcactggcacgcctgcaccgccacctccggctgcccgcagcatctcagcgaggccagccacacctttacctccggcgagtattccaacaattccagttcccactggcagatctgcaccatctgcggcggcacgtctgccaaggcttcccataccgacgccaacggcgacggcgtgtgtgacgtgtgccaccggggcggcatgccggtgaccaaccggatcaccgtcacctttatgaacggctccagcacatacagcacccagaccatcaccaagggctctacgccctccaaccccggcacgccctccaagtccgagagcggcaagacttactccttcgtgggctggtccacttccaaccccggcagctccgcgatctatgacgggcagagctacaagagttcttcccaggtggccagcaccgccctgagcgccaacaccacctattacgccctttacaacgtgcgctccaacaacaccattacgtattccgtcaaggccggcaagagcgtctccttcgaccgcaccgatttccgggatgtttatgagaacgaattctcttccggctccctgcgctgggtggaattcgagaccgacgacaccctctcctcctcccgcggcaccatctattatgattacggcggcagcgacgagaaggctttcagcagaagctctctggaagacgagcggttttattacagctccggcgacggcgactacgatctgaacaacctgagctttgtggccggtgacgagtcccgcaccgtcacgttggacttccgtgcctgctactccagctccaagtacgccgagggcaccttgatcatcgaggtggaaggcggctccagcagctcccacaccatcacctataaggtggataccgacgatgtggtggaattcgaccgccgggacttcaacgacgtgttccagcaggagtacagcaactacaccgtcaagtacgtcaccttcgagaccgacgacaccctctcctcctcccgcggcaccgtttattacgattatgaaggcagtgacgagaagtccttctccgccagcagcctggaggatgagcggttctattacagctccagtgacggcgactacgacctcaacagcctgagctttgtctccggcagcagcgagcgcaccgtcacgctggacttccgggcctattactccagcagccgctatgtggacggcacggtgaagatcctggtgggagacagcgccgacgacggcgacatcacctacgaggtggatcccggcgaggaagtctcctttgaccgggaggatttcaacgacttcttccaggaggagtacgaggactacgacatccggttcgtcaccttcgaaacggacgacaccctctccagctccaaatccggcctcgtgtattttgactacgacggcaaaaacgagaaatccttctccgacagcaccatcgacgactatgagttctactacaaagacagcgactacggcaaatacgccctggatgatctgagctttgtggccggcgataactttgacaaggccgtcacgctgcactttaccgcctactactccgacagccgctccgtggagggcgatctggtcatccgtcccaccggctccggcacgtcccagaagaccggcgacatcacctaccaggtggacaagaacggcgaggctgcctttgaccgggacgatttcagcgacttcttcgacgatgagtatgacggcgactacgagctgcggtatgtcacctttgagaccgacgataccctctccaactccaagtccggcctcatctacttcgactatgacggcaaagacgaaaagtccttcaccgacagcaccatcgacgactacgacttctattataaggacagtgaatacggcaagtacgctctggacgagctgaccttcgtggccggcgacaactttgacaaggccgtcacgctgcgcttcaccgcctactactccagcagccgccacgtggaaggcacgctggtcatcaacccctccggcacgtccgagaccggcgacagccagggcgacatccgctattacgccacttacaccaccaatgtccagatcaacgccaacgacatcgcccgcttcttcaacaagaagtatcccacgtccacgctgcagtacgtgacgctcaaggacgtgccctccaccggcagcctgtactataactactacggcgtcagcaagtacggtacttccaagctgaagctgaccagctccaactgcggcagctacaacctgtacttcagccccagctccaccagccagtacgctctgacggagctgacgtacctgcccagcggcaccaactactgcgcacagatccccttcaccgcctacggcagcggctccaagtccctgtccggcaccattctcatcagcgtgaacctctccgccgtgtcggaggtctacggcgtcacgcccaagggcaccgccgtcaccttcccggcctcggccatgtacattgcggtctccagtgccagcggccagggcctgagcagcatccagctgctggaactgcctgacagctccgtgggtaccatctacgtgggcaccggcacttccaccaaggccaacacctccacccggtacggctactccagcggcagccagcggatggggcagctgcgcttcgttcccgccagcggcttcaccggctccgtggagatcccctatgtggcctgcaacagcagcggcacccccatcgccgccggcaagttcagcctgggcgtggtgtccaacgtgaagaagttcagcgacatgacttcctccacctggtgctataagtacgtggtggagctcagcgatgccggcgtcatcgacggctataccgacggctccttcaagcccgacaacaccgtcacctacggcgcggccctgaagctcatcatgctggcggcgggctatcccgagcagaagcccaccgattccaaccccttcagcggatacctggccaaggcccgctccgagggcatcatcacccgcagcaacgtgaatctctccgctcccatcacccgtctgcaggtggcccagatcgccgcaggtgccctgaagctggacaccaccaatctctccagcgtccagcccttcacggataccacggatccctccgttcaggccctgaacgcggccggtattgtggaaggatacttctccggcggcaagagcacttataagcccaacaacaccctgacccgcggtcaggtctccgccatcgtctgg

SEQ ID NO: 2583 - DNA, 1941 bp, Oscillibacter sp.
atgagctattcagtacaaaacattcgtaacgtctgtctgctgggccacagtggcagcggcaagaccgccctggcagagagtcttctgtatatgaccggcgccatcgaccggatgggccgcagcgctgatggaaataccgtctgcgattatgatcctgaggagacgaagcgtcagatctccatctccaccgctgtggcgcccctggagtacaagggctgccgcatcaatgtgctggatacgccgggcgcgtttgatttttccggtgaggtgatggaggccctgcgggccgccgacgccgccgtgatcgtctgctccgccaaggacggcatttccgtgggcctggaaaaggcatggaaatactgcgaggagcggaatatgccccgctttgtatacatctccaagacggatgaggacaacagcgactacaacgccaccttcgatgcgctgcgggagcgtttcggcaagaagatcgcccccatcgtagtgcccatctgggacgagaacaagaaggtcaccggcatcatcgacgtgctcaataagcgtgccttcgagatgcaggatctcaagcgggtggagatcgaggtgcctgaggataaagcctccgtcatcaccgagttcaacgacgccctcaaagagtccgtggccgagacgtccgaggcctttatggacaagttcttctccggtgaggactttacctacgccgagatgatccagggcctgcgccagggcgtgcgggagctgagcctgttccccgtgctgtgcggctccgccgtcagctgcatgggctctttgatgctgatggacaacatcgtggacctgctgcccaaccccatggagggcaactaccacaaggctacccgtaccgatggcgagaccgaggagttcgtggtctctcccggcggcgtgcctacggcctttgtctttaagaccgtctccgaccagtatggcaagtattctttcgtgaaggtgctctccggcgccatcacgcccgacatgtctatggtcaatgcccgcaccggcgtcacggaaaagctgggccgcctgtatgtgatgcggggcaagaaggcaacggaagtcaaagagctgggctgcggcgacatcggcgccattgccaagatggaaaaggtcaagaccggcgatacgctgtgcgacgcccgtaaggtcgtggcgctgaagaatatccccttcgctgagccctgctactctgtggccatcgtgcccaagacccggggccaggaggacaagatcgcccagggcctgagccggatgaacgaggaggacccctccttcacggtcaccaacaacgccgagacccatcagatggtgctctccggtgccggcgatatgcaggtggacgtgctggtttccaagctcaagagccgcttcaacgtggaagccgagctcaagcccgtccgtgtcccctatcgtgagaagatccgcaagaccgtccagaagcagggccgccataagaagcagaccggcggcagcggccagttcggcgacgtgtggatccgcttcgagcccaatcccgaaagcgaggaaatggtcttcgccgaagaggtgttcggcggcgctgtgcccaagaacttcttcccggcggtggaaaagggcctgcgggaggcctgcgtccatggacctctggcggggtatcccgtggtgaacctgaaagccgtgctgtatgatggttcctatcatcccgtggactcctctgaaatcgccttcaagaccgccgcacagctggcctacaaggctgctatgccggaggccaaccccgtgctgctggagcctgtgggcgagctgaaggtcaccgtgcccgacagctacatgggcgatgtgatcggcgatctgaacaagcgccggggccgtgttatgggtatggatcccaccggtgacggcagccaggtgatcaccgctgaagtacctatggctgagatggggagc

SEQ ID NO: 2584 - DNA, 1521 bp, Oscillibacter sp.
atgcgcccttttgttgaaaacctgcccttcttgtgtattttcctggcgattttgacgggcatcgtctcggccgtgatcccccggggccgtgtgtgctactggatgacggtgacggtggcgggcatcatcgcggtgctctccgctgtggtactgcaatatacctatggcggtaatctcagctttacatacagcatgggccgctttgcggccccctatggaaacgcgatccagtgcggaccgctgcaggcgctgctggccatggtgttttccgtggtgcttgcgctggcgctggcaggcggaaagcgggatcttttccacgatgtgctgccgggcaagctgcggctgtacttcaccatggtgaacctgctggaggcatcgctgctggccctggtctacaccaacgacgtctttaccggatatgtgttcatcgagatcagcaccatcgccgcctgtgcactggtgatggccaaggacaacggtcccaatctgatcgccaccatccggtacttatttatgagccttctgggctcgggattgttcctcatcggactgacgctgctcaacagcatcaccggctacctcctgatgccctcccttgcccaggcggtggcggagctggcagagagcggtgattaccggatcccgctgacggtggcggtggggctgatcatcggaggacttggcatcaaaagcgccatgttccccttccacctttggctgccggatgcccacggcggcgccaccacggcatcttcagccatgctctcgggcctggtgctcaagggatacatcgtgctgatgatcaccatgatgatgcgggtgttctccatggagctgatgggagagctgggcgtgacaaacgtgattttggcctttggccttctgggcatgatcctggggtctttggaggccatgcgggaataccacgtcaaacggatgctggcctactcctctgttgcccagatcggctatatcttcatgggcctgggcctggggacgaccgcgggtgtggtggcgtcctgcttccacatcctggtccacgcctgctgcaagccgctgcttttttgctgcgccgggcgtctgtctgcggtcagcggccatcacaagagcctcaagaacctgcggggcagtgcctatcgggacgtgagcgccggcctgggctttacggtaggcgccctttccatgatcggtatcccgctcttcggcggatttgtctccaagctgtatttggccaacgcggcgctgcccaccaaccggacggtgctggcgctggtgaccctggcgctgtccacagtgctcaacgcactttactatgtgccggcgctgctggccatctgggtgcggccgccggcggaagcggagcagcacgttctggaggataccaggccggaggatctggcctttgaccgctcctttaccactgcggcgattgcgctgatggcgggaatttttgtgctgggcattttctatcaccccattactgatgtgctcgaggcgggaatcgccttgatgggaacttga

SEQ ID NO: 2585 - DNA, 2421 bp, Oscillibacter sp.
atggcaaatttacccagacgaaagacggacgccgcccggcgggccaatcagatcatccggacccggacggtgctggtcatggcgctgctgggtgttgttaccttcggggcgctgtttttgaagctcttcgacctgcagatccgtcagcacgacgaactgcaggaaaaggctgtggcccagcagacccgaagcaccgtcatcaccgcgtcccggggcacgatctacgaccggaacgggcatcctctggcggtgtccgctacggcggaaaacgtgttcgtggatcccaagggactgcagcagtatctggaggagcaggcggagcagggcaacacggaggtccgggacgccgaatacatcgcacggggcctgagccgtatcctggaagtggatgaggagaccatcctggagaagatggaaaaaaccagctccgcctacgagatcgtgaaaaagcgggtggaccaggaagtcgccgatgaggtgcgcaagttcatcaacggtgagatcgacgatgagggcaaccagctgacgaccgtcaacgacgatggagagaccgtgctgatctccgacccggataagagccccgtgcgggtccacggtgtgtacatggagccggactccaagcggtattatcccaacggcaccctggcggccaatgtgctgggctttgtcaacaatgacaatgtgggcggtgtgggcctggaggccaagtacgacagcgttcttcagggcaccgcgggccttaccattaccgcccgggacaacaacggcaacgacatgctctatcagtatgagcagtactatgatgcggaaaacggcaacagcctggtgctgacgctggaccggggcgtccaggcggctttggaaaagggcctttccagcatgatcaccaagttcgacgccgccaagggcggcacgggtatcatcatggacgtcaacagcggtgccatcctggccatggcgtcctaccctacttatgatcccaattcttatggtacgctgtacgatgaaaagctccagtcccagctggacagtcagctggcggagctggcccagaaccgggccgactatgagacggaggaggactaccaggcagctgtctctgcggccaagagttccgttttgagttctcagtggcgcaacaagtgcatcgattccacctatgagcccggctccaccttcaagcccatcactctggccacagccctggaagagggcgtggtggatatgaacaccaccttcaactgcaccggctccatcacggtccagggctggggacggcccatcaactgctccaagcgggccggccacgggctccagaccctgaaggtggccaccggaaactcctgcaacccggccttcgtcaccatgggcctgaagatcggcacggagacctattataagtacctcaagtccttcggcctgatggaaaagaccggcgtggacatgatcggcgaggtggcaggcattttcgccgatgaggaaagcttcaactccaacgtggtctccctggcgtcctatgccttcggccagaccttcaatgtcacgcccctggagctgatccgtgcccaggcggccaccatcaacggcggctatctgtataccccctatgtggtggagcaggtgctggacgacagcggcgccgtggtggaacagcatgagtccgtgcctgtccgccaggtcatcagcgaggagacctccgccaaggtgcgggagtgcctggagtgggtcgtctctgacggcggcggccgcaacggccaggtggccggctaccgcatcggcgggaagaccggtaccgccgataagaccggcaccaacgacgtagtggtctccttcatgtgctttgccccggcggatgatcctcagatcatcatgctgctgacgatggatacccccagccgtaccaccggcaccgccgtgttcggcggcaccatggtggcgcccaccgcaagctccatcatgagcgaggtgctgccgtatctgggcatcgagccggagtacaccgctgaagagctggccggcgccgacaccaccgtgcccaatgtagtgggcatgacgctggaggacgccaagacccggctgagcaacgcgggctttgcctgcaccaccgtaggcgacggtgccaccgtcaccgatcagacccctgccggcggcgccatcgtgcccaataacgcctccatcatcttgtatctgggagcggaaaagccggatacgccctgcactgtgcccaacgtggtgggcaagtccgcctcggaggccaataaggccctcaccaacgcgggactcatcatgcgggcctccggcgccaccacatccagttccggaaacgttcacgccatcacacaggatgtctccgccggaacacaggtccaggcaggcaccgtggtcaccgttcagttcggcgacaactccgtgctggactga

SEQ ID NO: 2586 - DNA, 1515 bp, Oscillibacter sp.
gtggcgggcgggaacgcgaaaaagccccgggagaaaaaagcgaaaaaacccagccgtctgacacggcagcagaagatcctgatagtggtggcggtgctgctggcactggtgctggccgtggtagtggcctgccagagcctgtttgtcaagccggatctggagacgaagaagccggagacggaggaagaagagctggactatggagacggtgtgcgtccccgcagtgatggcgagcgtaagagtgaagacttttacacggtcctgatcctgggccgggacaccggcggcggcggaaatacagacaccatgctcctggcctcttatgacgtgaccaaccagaaggccactgtcatgtccattccccgggataccatggtcaatgtcaactgggacgtgaagaagatcaactccgtctacaacatgaacggcggcggagacaagggaatcaaggccctgtatcaggagatctcccagctggtgggcttcgagcctgattaccaggtggtcgtggagtgggaagccgtgggcgagatcgtggacgccatgggcggcgtgtacttcgacgttccccgggacatggattatgaggacccctatcaggatctctccatccatatcaagaagggataccagaagctcaacggtgagcaggccatgggggtcatccggttccgggacggcgtcaatggatacagcaacggcgacatcggacggatcgagacccagcaggcctttttgaaggctgtgctggagcagatgcttcagatccagaacatgaccaaaatcaaccagtttgccaaggtgttccaggagaacgttaccacagacctctctttccagaacatcttgtggtttgcgcagaaggcgatcctgggcggactgaaggtggagaacgtgaactttgtcaccatgccttataagggcgtgtccgcctggagccgctattatcagcagaatctgtcttatgtggtgccggtggcggatgagctgctggagctggtgaacaatgaactcagccccttcaaagaggtctttacgctcagtgatctggacatcatgtatgtcaactccgacggctctatcggttccaccacaggccatgtggaggactccaaggccgccaagccgccggtgaaaaactccggcagttccaccaccacaacgacacccgatcccgacacggagacggtgaccgatcccaacggcactgtcacgacgccggaaaccggtgagaccggaagcgagaccggcaatcaaggcagcacagggactggcgatcaaactggcggcgagaccggcagccagaccggcaacgagggcggcacgcagaccggcgatccgtccggtgagaccggaagcgagaccgggaatgagggcaatgcccagactggcagtgagagcggcagcgaaagcggtgcccagaccggcggcgaaaccggttccggggaatccacatcccccgaagtcccttcggagccggatatttccatcatcgagccggctcccaccgaataa

SEQ ID NO: 2587 - DNA, 1695 bp, Oscillibacter sp.
atgtctgaagtcaaggatctggaaaatgagaccctgtcccaggcggaacccgtcttgccggatactgcggaaaagactgtgccgacatcccaaggggtaaagggaaagtggaaaaatatgccccgccagaagcggcgccgcatgatccgccgggtcattgcactggtagtggtgcttgcggtcgttgtgggactcatcaaggtattcggcggcaaaaaaacggacgatacgcagatcgtgacggataccgtacaatacggttccatcacctccaccgtagagggcaacggattgaccaaagcgaaaaagagcgagaccatcacgctcactacggcaggaaccgtgacggacgtcatggtgacggagggccagaaggtcaccgccggaacaccgctgttcacggtggattctgaggccgcccgcaccgccgtgcagaaagcccggaaggacgtggagggatatgagaagcagctcaataccctgcaaaaggacatcgcaggactgaacctggcggccggataccccggcaagctgatggacgtggtgacgctcaatcccggcgacaccatcaacaagggcgacaaggtagccaccctctcggatgacacgcgcctgcggctggagcagtattacagctatgcctatgccggcgacatcaaggtcgggcagaccgtgcaggtgtccattccctcgctgatgagcacgatccccggtactgtggaagaggtccatatggtcagccgcatcacgccggaggggtccaagctcttctccgcggagatcgtggtgaaaaatgagggcgccctgacggcggatatggcggcttccgccaccgttgccgtcaacggcgagaccgtctatccctatgaagcggggaaactggcgtattaccgcaccggagatctcacttccacggtcagcggcacggtgatctccagcagtctggtgaattatctgcaggtcaccgccggacaggtgctggtgcggattgacggcgagagcagcgagagcgagatcttcacggtgcagcagaatctggaagaggcccgcaagacgctggatactgcccagaagaatctggacaactgcaacgccgtggcaccgattgacggcacggtgatcggtcttgccattcagcccggttcggagctggaggccaataccactgtgatcaccattgcggatacctccaccatcgtggtggatgccaccgtggatgagcggaatgtgtcctatgtcaaacccggtatgtcggtggagatcgaccagtggggaaccaccttctatggcaccgtggatacggtgagcctgaactccaaggcggaaaacggtgtggccagctatcccatggtcatcagtgtggacaatccggatgggacgctgatgaccggcagctatgtcaactacaagctcactgccagtgagaatgacaactgcctggtcctgcccatccagtgcatcaaatccgtgcctctggaggatggaaccgccgcagacgtggtgtttgtcaagtccggcagccgtccggaaaacgccattgacatcaccaccacagtggagggcgtccccagcagcggcttctggcccgtgccggtggagacaggcatctcggatgactacaacgtggagatcaagtccggtgtggaggagggaatggaggtctttaccaccgcccccaccaccggaacctggtaa

SEQ ID NO: 2588 - DNA, 1947 bp, Oscillibacter sp.
atggaaatgaagaagagagtcctgaccggtgctctgtgcggtgcactgctggtagggacggtggttcccgcgctggctgccaccgagcactacaacaacggtgcctctgtgggcggcagcgccgagtggaccgcctggacccaggactgggagagcgtggccacggattacaccaaggtgtccctgacccccggcgctgacgagacggagctgaactttgcctggtacagcaaggacgacggcaaggcagccacccccgtggtccacttcggcacggaccggaacaatctcaagacctttaccggcaaggctgccgatgtggacgcctccctgaccgacggtgtggcctatgactacaaccatgtcaccgtcaccggactgaaggagaacaccacctattactacacggtggagaaaaacggtgtccagtccgacgtggagacctaccagacccgcagcttctccacggtgaagatgctctatgtgggcgatccccagatcggcgcctccaagggccagccccagggcggcgagacgctggcggctgacagcggcgccgccaataccgcggcccggaacgacgccttcggctggaaccggacgctggaggctgctctggcacaggaccccgatgtgagcttcatcatttccgccggcgaccaggtcaacaagaccggcaagcccaaggaggaggagtacgccggctatctcagccccgaggcactgacgtctctccccgttgccaccaccatcggcaaccatgactccctgaacgccgactattcctaccacttcaataaccccaacgccacggattacggcaccacccaggccggcggcgactactattactcctatggcgacgggctgttcatcgtgctcaacaccaacaactataacgtggctgagcacaagcaggccattgctgaggccattgcctccgatcccgacgccgcctggcgtattgtcaccatccatcaggacatctacggcagcggcctggatcactccgacaccgacggcatgatcctgcggacccagctgacccccatctttgatcagtacgacatcgacgtggtgctccagggccacgaccacacttacagccgctccaagctgctctacggcgacgggcagacccacggcgcctacgagttccagctcaacgccgacggcagcgactacgactgggatcacgcctacaacaccaccaacaacacccagatccccctgtcccccgctgacggcgacactgccggcgaggccctgctgaacaacttccaggccgacaacaagtgctacaccatcgagacggctgtgggcaacaccgtcaccaaccccaacggcacgctgtacatgaccgcaaactccgcctccggctccaagtactatgagctgatctccacccagcaggactacatcgccgagcgcagccagaactggctgcccagctggtccgtcatcaccctcagcgagacctccttctccattgacacctatcagctgaccgccgacggcaagacggagaagatcgactccaccttcaccatcaacaagaccggcgacggcgagagcctcaccgctcccctgacccgcgcccaggcggtccagcgcctgtatgacgctgccggccgtcccgccgtctccaccgccgcaggctttgcggatgtgtccgccgacgcctcctatctgaaggccgtggcctgggccaaggcgcagggcatcgtcaagggtgtcaccggtaccgccttccagcccgatgagaccatcacccaggcccagttcgcggccatgctgacccgctatgccgccgtcaagggcaaggccggtgcctccgtcagcgccacgcccgcccagggcctgagctatgccaagagcaacggtctgctgaccggcactgccgtcaccgcctctactgcggattacgccctgaccaagctgggctga

SEQ ID NO: 2589 - DNA, 1155 bp, Oscillibacter sp.
atggaatatacggaaggcgtgcggtttgacagcctgggactgtcaccggaaattatgcgcgcgatcgaaaaacggaatattaccgtgtccacgccggtccaggcgggctgcatcccccccatgatggactggcaggacgtgattgccaaggcccccaccggcaccggcaagacgtttgcctacggcatccccgttgtggagcatgtggacccggaggatgagagcgttcaggcggtgatcctggcccccacccgggagctggccattcagatcacggacgagatccgggacttggcggcgttcaagcctggtgtacgcacggtgtgtctctacggcggccagcccattggccggcagatcgacacgctgaaaaagcggccccagatcgtggtggcgactccggggcgcctcagcgaccacatgaagcgccgcaccgttcgggtggacacggtgcggaccgtggtgctggacgaggcggaccggatgctggacatgggcttcatccatgatgtgacccgcctgttggacaagatggccaatcgcaaaaacctgggcctcttctctgccaccatctcccgggaggtcatggacatcgcctgggtctaccagcgggatgccgcagagatcaccgttcgggaggacgagcagaacaagcccgacatcaagcagttccgtatggacgtctccttcaacggtaaggcggatgccatcgtcaagatcctggaggagaccggctttgaccgctgcatggctttctgcaacaccaagggctctacggagcggatcaccaagttcctgcagatgcagggcattgacgctgcctgcatccacggtgacatcccccagaaaaagcgggaggaggtcatggagcgtttccgtcagggcaagctccgggtattcgtctccaccgacgtggcggcccggggcatcgacgtggacgacgtggacatcgtgttcaactgtgatgtgcccgatgaaaaccaggactacgtccaccgcatcggccgtaccggccgggccaagcgccagggtgtggcggtgacgttcgtggcggactatccctccaaaatgcggatcgacgacattgcgcagaagacccgcaacgagatccgggaagtgcggttcgatgaaaacggccatttggcccaagtgtga

SEQ ID NO: 2590 - DNA, 1332 bp, Oscillibacter sp.
gtgatccaaacgattcgcaaagcgtggggcatccccgagctgcggaagaagatcatctttacactcctcatcctgctgatcttccggatcggcaatgctatcaccgtcccctacgtggacgtgacggctctgaaggcccagctgaacgccttcggcggctctattctgagcctgtacgatgtgatgtccggcggtgctttctctaccgcgactgtctttgccctgagcattcagccctatatcaacagctccatcatcatccagctgctgactgtggccatccccgctctggagcggctggcgaaggacggcggcgaagagggccggaagaagatccagtccatcacccgctatacgaccgtggccatcgcgatcctgcagggcttcggctactatatgatgatgcagcgctacaacctgctggccgtcagcgagcctaccatttggcacgcgctggtcatcatcgtctccttcatcgcaggttcttccttcgtgatgtggatgggcgagcaggtgaccgagttcggtatcggcaacggtatctccattatcctgtttgccggcatcctctcccgggtgcccaacatgatctccggcatgatttccggcgtccgctactggactgccgccaatgccggcacggagctgcctgagaatgtggctcccctgcatcccgcgctgatccccgtgatcgtgatcggtgcactggctctgatggtgttcgtcgtgttcatcaacgacgccgagcgccgcatcccggtccagtacgccaagcgtcaggtgggccggaagatgtatggtggccagagcacgcatctgcccatgaaggtgaatatgtccggcgttctgcccatcatcttcgcccagagcattgcctctttgcccatcaccatctggagcttcatcggcattcctgaggacggcacggtttcccgtaccatttacgatgccattgacacccagtccatcatctatatggtggtgtatttcgtgatgatcattggcttcagctatttctactccacgatccagttcaatcccattgagatcgccaacaacctgaagaagcagggcggcttcatcccgggcttccgtcccggcaagcccactgtggatttcatccgcaaggtcctgaacaagatcacgctgttcggcgccatctatctgggtatcgtggccctgtgccccatcctgctgggtaagatcgtggatcatgcctatctgtccatcggtggtacgtctgtcatcatcgttgtgggcgtcgcactggaaacggtgaaggcgctggaatcccagatgctgatgcgtcagtacaagggcttcctggaataa

SEQ ID NO: 2591 - DNA, 1548 bp, Oscillibacter sp.
atgaaagtaccgttcaagcgtattctggcagcggcggccattccgcttctgctattgaccggatgcaaaaacagcgggcctgtcagcagtctgcagccatcggaggattcccaggaggaagagtccgaaaacacccgggtggtcctgccggacaattttactctgccgtatgaacccaatcaaacgctggacccggtcacctgtccggacggggtgcagcagaccgtagggtccttgctctacgagggtctctttcggctggatgaaacgctgacgccccaaccgtggctgtgtacgtcttaccagtatgaccctgccacatatacctacaccttcaccctccgcagcggtgttttgttttctgatggttccgcattcaccgctgctgacgcggcagccacactgcgccgggccatgaattccgaccgctaccggacccggctttatcaggtcaccgatgtctccggaagcggcagcactctgacggtggtcctctccggtcccaacacctccttccctgccctgctggatattcccatcgtcaaggccggcacggagacctccctcacgcccatcgggaccggcccctaccagtttacctccggagagtccagcagccgcctgacggtcaatcccaactggtggaacggcggaacactgccggtccagcagatctttctctccgccgcagaggatcgggatacgctgctctatcagttctcctcccatgacatccagctgctcactgcagatctcaccggtacggatcccatcaccgccaccggcaacaccagctttcaggatgtggacaccacggttttgcagtatgttggaatcaacgtcaaccgtgccccctttgacaacgctgccctgcgcaaggcgctgaacctgggaatcaaccgggcctccctgatcagcgcgtttttgtccggtcacggctctgcggcgcagttcccggtctctccggtgtcccccctctatcccagtgaactggagtccgtctattcctacgatgcctttgcatctgccatgtccgccgcgggatataacaccggcagttccagccgtacagtcaaattgctggtcaatgaggagaatagtttcaaggtctccatcgccaattatctggctgaatcgctgtctgtctttgatttgaagatcgaggtggaaaccctaccctgggatgagtatatcgctgcactgagcgcaggaaattttgatctctattacggagaggtgaagctgactgcggactggaatcttatccgccttctgggtacctccggctcgctgaattacggccgctggtccgatgcccagaccgatcagcttcttgccgcctatgcttcctctacggaccaggctgctgccatgaagaccctgtgcgcctacttgcaggagcagtctcccattctgccggtatgctttaaatccaattcggtcctctatcagaccggtgtggtagaaaatctctcccccaccatgacagagcccttttataatctttcaaattgcatcatccatctcaaatccaattccatcacataa

SEQ ID NO: 2592 - DNA, 1764 bp, Oscillibacter sp.
atgttgaaaacgctttggccacatgcgcggccatattccaagtggatctgtctcggcgtgctgtgcagcgcggcagaggcggtgtttgagctgctgattccactggtcatgagtgatattgtggatattggcatcgcaaacggcgatcaggactttattctgcgcaagggcatccagatggtcatcatggccatggtgtctttgtgcttcggcctgggcgcggcggcctgctcttccatcgcaggcatgggcttcggcgccaatttgcggacggcggagtatgaccatatccaggattatgccttctccaacatcgagaagttctccaccgcttcgctggtgacccggctcaccaacgatgtcaacaacctgcagatgacgctgatgtttgccatgcgtctgctggtgcgggcaccggtgatgctggtggcggcgctgtttttgtctgtgcgcatcagctatcagctcagcaatgtttttttggtggcattgccggtgctgatcgtgtcggtggtactgatccttaccaaggcaagcccccgcttccgggccatgcaggaaaagaccgatgcgctgaacctggtggtccaggagaacctgacggggatccgggtggtcaagtcctttgtgaaggaggaccacgagcgggagaagtttgccaagagaaatctggacctgaagtccaacgctgaaaaggctttcggtatggtggtcatcaacatgcccatcatgatgctcattgtttacggcaccatcattgccgtcatgtggttcggcggccagatggtgtatgccggttctctggaggccggcaagctcatcacgttcttcacctacattacccagatcatgatgtctcttatgatggtctccatgatcttcatgatgatgacccggtccattgcctgcgcccgccggatcgcggaggtgctgcgggagaagcccgccaccaccaatgacgacgccaagatggataccggcgccgacggcagcaagacgcctgctgaggtaaagaacggcagcatcgacttcgaccatgtttccttcaaatatgacctcacaagccccgagtggattctgcgggatgtggatctgcacatccgctccggccagacagtgggcatcctgggcggtaccggctccgccaagaccaccctggtgtccctgatcccccgtctttacgaggccagtgagggcactgtcaaagtgggcggccgccctgtggcggactacaccatggagcatctgcgggacgcagtgagcgtggtgctgcagaagaacaccctcttttccggtaccatccgggaaaacctcctctggggcgatccccatgccacggaggagcagctgtgggcggcctgccgggcggcctgtgccgatgagtttttggagcggatgccagacggactggacacggacctgggccagggcggcgtcaacgtctccggcggccagaagcagcgtctgtgcattgcccgggccattttgaagcagcccaaggtgctgatcctggacgattccaccagcgcggtggataccgccacggacgctaagatccgcaaggcctttgccaatgaactgggggacaccaccaagatcatcatcgcccagcgggtgacctccatctgcgaggcggatctgatcctggtgatggacggcggccggatcgtggcccagggcacccacgacgaattgatgaacagctgtgacatttaccgcgaggtctatcagtctcagcaggaaggagtgagcatcggtggctga

SEQ ID NO: 2593 - DNA, 1728 bp, Oscillibacter sp.
atggacttcatgaaagaatacgaaaagtggctggcaagccccgctctgtctcaggaggagcacgcagagctggaatccatccgcagcgaccccaaggagatcgaatcccgcttctatggccctctggaatttggcaccgcaggtctccggggcaccatggccgtcggcctgcataacatgaacatccatgtgatccgctgggccacccaaggttttgcggatgtcatctctgccgagggggaagaaggcaagcgccggggcgtggccatctgcatggactgccgcaaccactccatggagtttgcccgggccgccgcagaggtctgcgccgccaacggcatccatgtccgcatctttgagtccctgcgccccacacccgagctgagctttgccgtgcgggagtatcactgccaggcgggaatcaatgtcaccgccagccacaaccccaaggaatacaacggctataaggtctactgggaggatggtgcccaactgccgccccaccatgccgacgccatcgccaaacgtctggaagagatcgacgtatttgccggcgtaaagtccatggactacgacgaggcggtgaaggccggtctgatcgaagtgctgggcgaggagacggaccagcggtttatggccaatgtcacctccatgatcaacgacaaagagacggtagccaaggtggcagataccttcaagctggtgtacacgcccttccatggctgcggctacaagctggtaccggaggcgctgcgggctctgggcatcaagcacctgatctgcgaacccaagcagatggtaatcgacggcaacttccccacggtggcctctcccaacccggagaatcccgagggcttctatctggccattgacctggcccgtgaaaacgatgtggacttcatcctgggtaccgatccggacagcgaccgtgtgggcatcatgatccgggaccacagcggcgaataccgccccgtcaccggcaaccagaccggcgtgctgctgctggattacctgatcggcgccatgaagcgttccggaaagctgccggaaaagccggtggctctgaaaaccattgtgaccacggagatggcccgtaaggtggccgaggccaacggcgtggcctgctacgatacctttaccggcttcaagttcatggcagaaaagaagaatgccctggaagagagcggccaggggaaggtcatcttctcctacgaggagtcctacggctacatgttgggcgattacgtccgggacaaggacgccgtcaccgcctccatgatgctcacggagatggccgcctggtatgccgcgcagggcacgaccctctttgacgctctggaaaagctgtatgaaaagtacggctactacgccgaaaagacccacaacctggtgatgcccggactggacggtctgaaggacatggcagagctgatgaagaatctgcgggagaatccccctgcggacatcggcggcgtaaaggtcgtcacccgcaaggattacagcaacggttccgtagtggactgcgccaccggtgaagcctccaccatggagctctccggctccaatgtgctgcgcttcgagctggccgacggtaccagcgtgatcgtccgcccctctggtacggagcccaagatcaaggtctacatccttacccgtggcgccgatgccgctgcctgcgccgccaatctggagaagtacggccagtgggtcgccggactgaaaaagtaa

SEQ ID NO: 2594 - DNA, 2004 bp, Oscillibacter sp.
atgaaacttgcacagaaatcccccgctgctccggatgccgggcatccgcaggaacgcagggcgttcctgtatgtctttttgctggcggtggtactgacactggtggtggagctgttcaaccacaaggcgtttaccagcggggcggactcgtttttggaatttgtgtgcggaaatcctctggccgctgtcgtcaatgtggcactggtactggctacgttgtctccggcgctgtttctgcgccggcgggccttctggtgcgcgctgatttcctttatctgggtcgtgggcggcgcggtgaacggattcatcctgctcagccgtatgacgcccttcaccgtggcggatctcacggtgttcaacaccggcctggacaccctgcccaactacctctccaccaaatatattgtcatgctggcggctgcgctggtgattttggtggtgggactgatcctgctgttctggaagggcccccgcaatgactatcccctgcgccaccggatggcagccggactgctggcggtggtgctgtgcggcggactgctgggcggcagctgggccctggccttccgcctgggatacctctccaatacctttgccaacctggcttttgcctatgaggactacggcttttcttactgcttcctgcagacctggctgaacaagggcatccgccggccggagaattacaatgccgagtcggtgcagaaactccgccagcaggcggaagacgctgccgctgcggtaaacgcagatccccagacggatgtgaacgtgatctacgtgcagctggagtccttcattgatcccaaggagatcacggacctggagctgtccgaggacgcggtgcccacctggaccaggctcacggaggagtactcctccggctacctgacggtgcctgtggtgggtgccggtaccgccaataccgagtgcgaggtgctcaccgggatgagcaccaagctgttcggccccggcgagtacccctaccagacccgtctgatggaccggacggtggagtccgtggcctatgacctcaaggagaacggatacgccacccacgccatccacaaccaccgggctgccttctacaaccgcaacgacgtgtatgccaacctgggctttgacgacttcacctccatcgaatatatgcccaaggcggagcggacccccaagaactgggccaaggacagcatcctcaccgatcagatcatcaaggcgctggatgtgacggaggaccagtcggatctggtgttcaccgtttccgtgcagggccatggtaagtatcccaccgagcaggtgctggaggaccccgccattacggtgaagtcctgcccggacgaggaataccactatgccatggagtattacgtcaaccagatccatgagatggatcagttcatccagacgctgaccgacgagctgtcccagcgggatgaaaagaccgtcctggtgctctacggcgaccatctgcccgcattgaacctggaggccagcgacatgaaggccggtaccctctaccggacccgctatgtgatctgggataacttcggcctggagaagcaggacgagaacctcaccgcctaccagctctctgccgcggtgctggggcgtctgggcatcaccaacggcgtcatgaaccagtaccagcagttctgccgggatgagagcacctactggaacggcctgtggacgctgcagtacgacgtgctgtacggccagaagtacctctatgatggggagtctccctatgagcccacggatatgaagatgggcatggcgcccattaccatccgctctgtgacccacggtatggacgcctggtatatcaacggcgagaacttcagtccctactgtaaagtcaccgtgggcggcaaggaactcaagaccgcctatatctcgccctggatcctgcaggtgcaggagaacccgggcaccatggatgtggaggatttcaacatccgggtcatcgatacccacaaggagatcctcagcgatacggaataa

SEQ ID NO: 2595 - DNA, 2568 bp, Oscillibacter sp.
tggcagaagaaccggatggagctgttccgggacctgaaatgcggagaggacggcctttccgcccaggaggcaaaggcgcggctggaaacctacggccccaatgaactccacagcggcacgaaaaaaagcgtgctgcggatcttcctggagcagtttgcggactttatcgtcatcattttgatcctggcggcactgatctccgccgccatgggagatgtggagagcacggcggtcatcctggcggtcatcactatgaacgccatcctgggtaccgtgcagacggtgaaggccgccgcttcgctggacagtctcaagcagatgtccgctcccacggccaaggtggtgcgggacggcacggtgctccaggtaccgggccgggacgtggtgcccggtgacgtggtggtgctggaagccggcgacgccgtgtgcgccgatggacggctgttggagtgcgccagcttgaaatgcgcggaaagcgcccttaccggtgagagcctgccggtggaaaaggaactgggagagatcggcggcgaagtggcgctgggcgaccggaagaacatggtgttctccggcagtttcgttacctacggccgggcccggttcctggtcacgtccaccggcatgaacaccgagatgggcaagatcgccacgctgctgaaaaacacggaggagaaaaagacccccctccagatcagcctggatcagttcggcaaaaagctctctgtgggcattctggtgatctgcgcggcgctctttgccgtgagcgttttcctgcggggcgagaatatcatgaacgccttcctcttcgccgtggccctggcggtggcggcggtgcctgaggcgctgagttccatcgtcaccatcgtcctctccttcggcacccggaagatggcccgggaaaacgccatcatccgcaagctccaggcggtggagggcctgggcagcgtttccgtgatctgctccgataagaccggcacgctgacccagaacaagatgaccgtcaaaaagctctataccggcggcaagatcgtggacgccgaccaggcggacttcagtgatcccatccaggagccgctgctgcggacggctcttttgtgcagcgacgccaccatcaatgaaaacggcgaagtgggcgatcccacggagacggcactggtgcggctgggtgaggccaacggctttgatgaggaagtcacccgtggcaagtatccccggctgacggagatcccctttgactccgaccgcaagctcatgagcacggtccaccgtctctccggcggtctggtgatggtcaccaagggcgccgtggacgtgctgctggaccggtgcgtgatctccgacgccgagcggaaggagatcgagcaggtcaacgaggaattttccagccagggtctgcgggtgctggcctttgcctgccggacggtggaggataccgccgtctctctggaggatgagaacggcctggacttcctgggcctcatcgccatgatggacccgccccgggaggagtccaaggccgctgtggcggagtgtatcgccgccggtatccggcccattatgatcaccggcgaccacaaagtcaccgccgctgccatcgccaaggagatcggcatcctgacgccgggcaccgaggcggtggagggcggtgccatcgacgccatgagcgacgaggagctgcgagaattcgtacccaaggtctccgtctatgcccgggtgtccccggagcataagatccgcatcgtcaaggcctggcaggaccggggcaacctggtggccatgaccggagacggcgtcaacgacgcccccgccctcaagcaggcggacatcggcgtggccatgggcgtcaccggcaccgaggtggccaaggacgccgccggcatggtgctgacggacgacaactttgccaccatcgtcaaggcggtgaaaaacggtcggaatgtctatgccaacatcaagcgggccattcagttcctgctctccggcaacgccgccggcattctgacggtgctctatgcgtcgctgctgggtctgccggtgccctttgcagccgtgcatctgctctttatcaacctgctgacggactccctgcccgccatcgccctgggcctggagcctcacaccgaccgggtgatgcacgagaagccccgcccccggaacgagggcatccttacccggcccttcctcaccagcgtggccatcgagggctttgtgatcgctgtggcgaccatcgtggccttccacatcggtcttgccaatggcggcgcggcccttggaagcaccatggcgttttccacgctgtgtctgagccgcctgttccacggcttcaactgcaaagcagaccggccggtgctcttcacccggaccttctggaacaacagcttcctgctgggcgcctttgtcatcggcgcggtgctgctgggcgcggtgctgctgatcccgcccctggagccgctcttccaggtggcgcctctctccgccagcctggtggggaccatcgtgggccttgcggccggcagcatggtggtgatccagctgctcaaggccatccggacccgtggggaaaagtaa

SEQ ID NO: 2596 - DNA, 1416 bp, Oscillibacter sp.
atggaaactctggagaaaaagggaaaaggttccgcattgcttccgttcctgctgttcatcatcatctacctgggcgccggtttgtattaccaggccaagggggtggaaatggccttctaccagttcccctccgtgaccgccatgttcatcgccgtgctgctggccttctgcatgggcaagggcagcatcgatgagaagtttgctgtctttgccaagggtgctgccaatgaaaacgttttgaccatgctcatcattttcatcctggccggcgccttctccaccgtggccagtgccatgggcggtgtggattccaccgtgaatctgggactgagcgtggtccccgtccacttcctggcggcgggcgtgttcgtgatctccgcctttatgggcaccgccaccggcacctccgtgggcaccatcagcgccatcgttcccatcgccgtgggcgtggcggacaagggcgggctgagcctgccgctgtgcgtgggcgcctgcgtgggcggcgccatgttcggcgacaacctgtccatgatctccgacaccaccatcgcggccacccgtacccagggctgccagctgcgggataagttccgggtgaacttcttcatcgccctgccggcggcgctggtcaccatcgtgctgctgctgattttgggccggcccgagaccgtggtccccatggatgagctgaccttcaacatcatcaaggtactgccctacctggcggtgctgatcctggccctcattggcctcaacgtctttttggtgctggtcatcggcatcttctccgctggcatcatcggcctggcgctgggagatctgaccatcgccacctttgcccagagcgtctacagcggcttcaccggcatgaacgaggtgttcttcctgtccctgttctgcggcggcatgtcggagatgatcgcccacaacggcggcatcacctggctgatcgaaaagctcagccggatcatgaagggcaacaagtccgctcaggtgggcatctctgcgctggtgtccatggcggactgcgccaccgccaacaacaccgtggccatcatcgtcagcggcaacgtggcccgggatatgagccggcagtacaaagtggatccccgccggaccgcttcgctgctggacgtgttctcctgcgtattccagggcctgatcccctggggtgcccagctgctctctgctgccagcctgaccaccgtgaccagcggcatcgtcatgagccctgcggaatttttgccctacatgtggtactgctggatcctggcggcgttcggcgtgctgtccatcttcatcccctatgccgacggcatctgccgcaaggacccctggaactgggagtatgatgtggcggagtccggtgtggcggcgaagaaggctgccatggaggctgccggggagaaaaactga

SEQ ID NO: 2597 - DNA, 2247 bp, Oscillibacter sp.
atgccgaagaaaaaacagagcgacgaaaccaaacccaaagtgaataaccccaacgtgatggggctgcacgcggcagtggtggagcagcccatcaccgatacgctggagctcaactacatgccctatgccatgagcgtcatcgtctcccgggccatcccggagatcgacggcttcaagccctctcaccgcaagctcctctacaccatgtatcagatgggacttttgaccaagccccgtacgaagtccgccaacatcgtgggccagaccatgaagctcaatccccacggcgacgcggccatttatgataccatggtgcgcctctcccggggctacggggcgctgctgacccccttcgtggattccaagggcaacttcggcaagtgctattcccgggacatgtcctgcgcggcgccccggtacacggaggccaagctcacccccatctgcgcggagctgttccgggacatcgacagcgataccgtggactttgcggacaactacgacaacaccatgaccgagcccacgctgctgcccaccacgttccccaacatcctggtctccgccaacagcggcatcgccgtgggcatggcctcccagttctgcggcttcaacctcaaggaggtctgcgagaccaccatcgcctatctgaaaaacccggactgtgacctgacggaaaccctgctggcgccggatttccccaccggcggcgagctgatctgcgacccggacgccctgcgggagatctatgagaccggccggggcagcgtccgggtccgggccaagtaccggtatgtcaaagcggaaaacctcatcgagatctacgagatcccctactccaccaccgtggaggccattctcgacaaggtggcggagctcatcaaggccggtaaggccaaggagatcgccgacatgcgggatgagacggacctctcgggcctcaagcttgccatcgacctcaagcggggcgtggatccggacaagctcatgaccaaactctataagctcacccccctggaggacgcctttgcctgcaacttcaacgtcctcatcgccgggatgccccgggtgctgggggtgcggcaggtgctggaggagtggaccgcctggcgcacggagtccgtccgccggcggaccttcttcgtcatgaaccagaagaaggacaagctccacctgctcaagggcctcaagcggattttgctggacattgacaaggccatcaagatcatccgggagacggaggaggaaaccgaggtcatccccaacctgatgatcggcttcggcatcgaccagacccaggcggagtacgtggcggagatcaagctgcgcaacatcaacaaggagtatatcctcaagcgggtgcaggagaccgccacccttcaggacgagatcgcggacctggaggacatcgtggccgatccccggcggatccggaagatcctggtgtcggagctgacggaggtggccaagaaatacggcgagccccgccgcacctccatcgtctacggacatgagatccaggtctatcaggaggagtccgaggtggaggactatcccgtccatgtcttcctctcccgggaggggtactgcaaaaagatcaccccggcctccctgcggatgaacagcgagcagaagtacaaggagggcgacggcctgctccagacctttgagaccaccaacaatgcggagatcatgttctttaccgatcactgccaggtctacaagacccgcctgagcgaatttgacgacaccaaggccagcgtcctgggcgattacctgccggcaaagctggccatggaccccggcgagaatgtgatctgcgccgtgctgccgggcccggattacgcgggggcgctgctgttcttctttgaaaacggcaaggccgcccgggtggagatcaagtcctatcagacttcctccaaccgccgcaagctcaccagcgcctattccgacaagtctcccctgcggtgcatccgccgcatcgacgcggactgcgaactggcggtgtactccacggagccccgggtgctgatcttccacacggcgctgctggcgcccaagaccacccgcaccacccagggggtggcggtgatgaccctcaagcccaagtaccgcctggacaccgtcaaggccctggaggagaccgccatcaccaaccagagccgctaccgggtgcgggccatcccggcggcgggggccctgctgcgggaggcggactccgaggagcagcagatcggtcttctggagtaa

SEQ ID NO: 2598 - DNA, 1323 bp, Oscillibacter sp.
atgaaacggattcacaagcgatttcagggactgtactggcgccagctgttcgtcacggccggcatggtgatgctgacgctgtttctgctgggcacgtccttcttctccctgagctataactatgcccgcagccagcagagcgacgagcttttggaccgggcggagatcatgagccggttatccgtggactatctggagagcggccggtatctgaatattgaggacctgcgcaacgaccccggctttcagcagctggcatccttcggtgccacggtgtcggatgtgcagtttatgatctgcgacacagaggggcatgtgctcctctccaccgacgaaaatctcagcggcaaggtggtcaccatgccggaggagatgacccgggagatcctggaggaagggtccacttcccatcgggacgatctggacgggctgtacgagcaaaagcggatggttgtcggcgttcctgttgtgaaccgggacacggaccggaccgtgggagtggtgtatgccgtgtccctctccacgtcggcggacaccatgtggcagggattcgtgggactcttcttcatgacggcatttgtggtgctgatgatcgccttcatggcctcctccatcaccgccatgcggcaggtccagcccattcgggagatggtgcaggccacgcggcagtacgccgagggagactttgacgtacgcatgaaggattacgggcagcgggacgagatgggagagctggcagcctccttcaacaacatggcggagtccttccagcagacggagcggcagcggcgggagttcatcgccaacatctcccacgagctgaaaacccctatgaccaccatcgccggctacacagacggcatcctggacggcaccatcccgccggaaaatgagcggcagtacctgcagatcatctccgacgagagcagacggctgagccggctggtgcggcggatgctggacgtgagccagctgcaggtgatggatccgctcaaaagcggcagccatttcgacatctgcgaaagtatgcgccgggtgctgatctccatggaaaagaagatcacggaccggcatctggacgtggatgcggacattcccgaggagcccattctggtgcggggcgacaacgatatgatcacccaggtgatctacaatctgttggaaaacgccaccaaatttgcccgggaggggacgacgctgtatctgggcgtcaccaccatcgacggtaaggcccgggtcacggtgcggaatctgggggataccatccccgcagaggagctgccgctgctgttcgagcggttccataaaagcgacaaatcccgc

SEQ ID NO: 2599 - DNA, 2154 bp, Oscillibacter sp.
gccgtggccatcgaggacgagcggtttttctcccaccacggcgtggactggatgcggacggtcaaggccacgctgaacatgttcaccaacaatgataccttcggcggatccaccatcacccagcaggtgatccgcaacatgacccaggacaacaagtccactgtcaaccggaaggtccgggagatcttccgggcgctggaatttgaaaagcactataccaaaaccgacatcctggagatgtacctcaacctcatctacctggggaagagctgctatggcgtccagacggcggcggagtactacttcggcaaggacctcagtgacctgagcgtggcggagtgcgccagtttgatcgccatcaccaacaacccctctttgtacggtcccatgtccaacatcactatcacccggagtgacggctccaccgtcacgccccgggagctgaacaagcagcgccaggaactgatcctggacaagatgaccgagatcaaggacccggagacgggagagcccttcctgacggaggaagaggcccaggctgccaaggaggaggtgctgcagttcacggacggctccacttctgccgaggatctggtggagcaggctaccggcggtacgcagatcaacaactggtttgtggacgaggtcatccgggacgtgtcctccgatctggcggaggagctgaagatcaccgaggacgaggcgctgctgcgggtctacaacggcggctataacatctataccaccatggacccggacatccaggccatcgcggaggaggtctacggcgaccgcagcaatctggatgttacctcccgcaacggccagcagctccagtcgggtattaccatcatcgatccctccaccggcaacattgtggccatggtgggcgctgtcggggagaaggagggcaacctcctgaccaactatgcccggctgccccggcaggtgggttcctctatgaagccgctgacggcttatgctccggcgctggacgaggggaccatcacgcccgccaccgtatttgacaactacccggtccagctgctcaacggcaacccctggcccaagaactcgcccaacacctatacgggacggacgatcctttccaccggcatcgctaaatccatcaataccattgccatccaggcgctgcagagcgtaggcgtggcagatgcgtttgcctttgccacggaaaagctgaacctgaacctggtggcggaggatatgaacctctcgtctctgggcctgggcggtctgacctacggtctgaccaccgaggagatggcagcggcctacgcggcgtttgccaacaacggcgtctataattctccccggacctatgtccgtgtcaccaagaccgacagcaccaccggagaggagacagtgatcctggaaaatgaggcggagagccatgtggccatgaaggagaccacggcctatctcatgaccaagatgctcaagggcgcggtcaccagcggtaccgccacctctgccaacttcggcggcatgaccatcgccggcaagaccggtaccaccagcgacaactacgaccgctacttcgtgggttataccccctattactgcgcggcggtctggaccggctacaagtccaacgaaaagatcagctactccggaaacccggccatcaccatgtggaaaaaggtgatgcagaagatccacgaggagcttcccaacaaggactttgacaagccctctaccggcctggagaccattcaggtctgcctggacagcggcctgctgccctcggatgcctgctctcaggatgtccggggaagccggatcgtctccgtggaggtagccgccggtaccggccccaaggagacctgctccatgcacgtgctgcgggattactgcaccgagggcaagtgcctggccggcgagttctgcccggcggattccgtggtgcagaaggcgtttttggactatgagcggacggattacggctccgggatcactgcggaggacgatccgtacctgatcgtgaatctggaaaaggcggcggagagcggctgtcccgtccacacccaggcgacggaggagccggagaacccggacgccgcaacagaccccaacgaccccaattatattccgcccacagatgattcctccggagagggaaccgaaccggaa

SEQ ID NO: 2600 - DNA, 1827 bp, Oscillibacter sp.
atgaaacgcatgctttccctggtgctatccctgattttggcttggtcccttaccatcccctcgctggcggcggaggatctggatccgccgctttggcagcagatgggcttttcctcccgggaagagtgcattacatatgtctatgggaatgaagatgcctatgagcaggcggtgcaggaggccctggaacgccagcggtgggaggacgccatggccgatgacatcgcggccttcgatccggacgcctactgggaatccgacgagtgccagtacagctggttctatgactccaaggaggagttcatggaggactggttcctggagacggaagaggagttccgggacgtgatgctggaagattggctggatcagcagtgggatgcctactggcaggagacgctggtggaccggacccgggcggagctgggagctcccgcgggccagaccggcgtgatgctggacggcacgtacctctccttcccggggagcgccgcgccggaagtggtcaacggctgcaccatggtgccctgcggcccgcttctgacggccttcggcggaacggtcagccacacgggcagtgatgtgacgtgtacgctggacggcgccgtttaccgcctgcgcagcggcagcgacaccatcaccgtcaccgccgctgacggaacggtctccgagatcccgctgggggtggcctgctatgagaaaaacggcgccacctatctggcactgcgtccgtttgccgaagtcatgggctgcgatgtcatgtgggacagcaccttccagaccgcggtgctgctgcggcgggacaaggtgatcgcccagctggatgagcagttcacgctcatcaatcagatgtttgcggccatggagtacgatgcgtccaagaactacaagaccgtggcgcggatggatgccaagctcaccatgctggattccatcaacggagacaagcagtatcccatggatgcggatgtggagatgctgcaaagcggcggtactgtgaatttgaaactccccatggacctctctgccctgctggagatcccgggcgcgctggacgggatggacccgctgtctgccgcggcggtgaaggggcagctgcggaacgtgaagatggagatgatctatgacgcagagggcggcaccctgtacctgaagatgccgctgctggcccagctcaccggcgggcagctggacgaggacagctggatcgccttccctgcggcagatcttacccagatgcccgtgggcaccagcaccaccatgggagcggtcctctaccagagcatgcggcagcaggcggagctcatgtccagctttggatcctattattttgagggcatgatcacccccgccatgctgtaccgggaagtgtttgtcagcgcagaagaggcggcggcctacctgggagacgactgctttgaagccagcggcggatacagcgtcctccattacgacgaggaggattacaacgcctatctggagtccgagtacggtgagggctccgcggagtacctcagcgagtttgagcagctggagatggagctgaaggtcgcccgttcgggtgcggccaccttccgggtgctgatgcagaccaaggcccaggggatgtactcccccgccatgctgctggacatcagcggcagccagagtcccacccgtgtggacctgagcatgctgatgaagctgaaaaaccagttcaatctggaactgacctataccggcaataccaccgaaaccgaccagaagcccaacaccgctcctccggcgggagagacggtgatcgacccctatgaatcctatatggtgccggagcctgcggcggcgtaa

SEQ ID NO: 2601 - DNA, 1959 bp, Unknown
  Description of Unknown: Clostridiales sequence
atgttccatcgaccgggagccctttttgatttctcttgctcggcggaactcaattccgcctgcgccaaggttttcctccggaaaacgcttgtgacgccgcacttgcggcgggcgctctttcgatactattactctttttcaaaaggagatcactctatgaaccaggaaaacatccgtaacttctctattatcgctcacatcgaccacggcaagtccaccctgtccgaccggcttatcgaagcctgtggggcggtgtccgccagagagatggagaatcagatcttggactccatggatctggaacgggaacggggcatcaccatcaaggctcgtgccatcaccctgcgctacgaggcggacgacggggagacctacatcctgaacctgattgacacgccgggtcatgtggacttcaactatgaggtcagccgcagcctggccgcctgtgaaggtgctgtgctggtggtggacgccagccagggcgtggaggcgcagacgctggccaacacctatctggccattgagcatgacctggaagtgctgccggtcttgaacaagatcgacctgccctctgccgatcccctgcgggtgaaggaggagatcgagaacatcatcggtctgccggctatggacgcgccggagatctccgccaaggcgggcatcaacatccacgcagtgctggaggacatcatccagaacgtgcccgctcccgccggggacgaaaacgctcctctgaaggcgttgatcttcgactcccagtatgactcctaccgcggcgtcattgttctgatgcgagtcatggaaggaagtatcaagaccggtatggacgtgaagatgatggccagcggggcagtctacaaggtggtggaatgtggccatatgctgcccatcggtctggacccctgcggcgagctgcgtgccggtgaggtgggctacttcaccgcctccatcaagaacgtccgggacaccagcgtaggcgacacggtcaccagcgtagagaatccggcggcagaaccgctgcccggctatcgtcctgcccagcccatggtctactgcggcatctacaccgaggacggcagcaaataccccgacctgcgggacgccctagaaaagctccagctcaacgacgcctctctgagctttgagccggagtcctctgtggcactggggttcgggttccgcgtgggcttcttggggatgctccacatggaggtcatccaggagcgtttggagcgagaatttgacctggatctggtcaccaccttgcccagcgtcatctatgaggtcatcaagaccgacggttccactgtcttcgtggacaacccccacaactaccccgacccgggcagcatttccaaggcgttggagccttttgtgaacgtgtccatcatctcgcccaacgagttcgtaggcaacatcatgcccctctgccaggatcgccggggacagttcgtggatatgcagtatctggacacccacctggtggagatccactacaagatgcctctgaacgagatcatctatgacttctttgataccctgaaagcacacaccaagggttacgcttctttggactacgagctgtctgactaccaggagagcaacctggtgaaggtggacctgctgctcaacggcgaccaggtggacgctctgtcttttattgtccataaggataaagcctataagcgtgccagaaagatctgcgaaaagctcaaggataacatcccccgccagctctttgaagtgcccatccaggccgccatcggcgggaagatcatcgcccgcgagaccgtcaaggccatgcgcaaggacgttttggctaagtgctacggcggcgacatcactcgtaagaaaaagctgctggagaagcagaaggaaggcaaaaagaagatgcggaatcttggtacagtgcaggtgcctaccgaagccttcctggctgtcctcaagctagatgagtaa

SEQ ID NO: 2602 - DNA, 1386 bp, Unknown
  Description of Unknown: Clostridiales sequence
atgcgaaacctattatccctgctcctggcctgcctgaccgccgtcaccctcaccggatgcggtctcaagtccggagaagacctatatcagctgcccaaggcgtccgcggaatatgagagcttgcagacctgtctggaggacatcctggatcagggtctggagtactccgcccccctcaccggctccaacctccagtccgtccagctcaccgacctggacaacgacggcaccaacgaggccatcgccttcttccgggacagctcggcagaaagtcagtccttgaaactctacatcttccggcaggtcgagccgaatcgctacgcccccgcgttggtcatcgagggcaacggcaccgccatcaactcggtggtggtctgccagctccagggcggcgcggactccatgcgggaactgctcatcagctggcagctctcccccaccgtctacgccctgtccgcctactccctggacaactacagcctgacagagatgctcagcagctccacctacaccaaatacactgtggacgacctgaatcaggacggcaacgacgagatcgtcctcatccagctccacagctccgaccaggacagcaaccgggcggactactatgtggcgcagggcggcatgatgacgatgcacaacagcgtcttcctgtccaaaaaactcagttctatcgaccgggtcacttgttctcccctgcccaaccggcacaccgccctgtacgtcaccggttccgctctggcgcccaacggtgaggccagcgcctccacggttatcacggatattttggccatccgcgaggacgacctgaccaacatctccatgggcaagggcgagctgaacagctcgtccaccctgcgcagcaaccagacccaggagcaggacatcaactcggacggcattgtggagatccccatcccctccctggtggagagctatgggcagtccgccgggaaggagaaattctactccctccactggcagcagtacgacatctccggcgccttccacatggcctgcgtcacctatcacaacaccaacgacgggtggtatctggtggtgcccggccactggacgggacacatcagtctgatgcggacggagaacacgtccagcctgacggtggagcacagcatcgtgttctactaccggggcacccagcgggacacccctgtccccttcctggccatctaccgcaccaccagcagcgaccggcagacccgcatcgaccgcgctcagaagagcggccggttcgtcctgcgctctgacccgggtaccatctactcggcggagtttttcgactgtgactgggactgtgggctgacggaggacacgctgaaggagcagttccatctgatccagccacactggtccaacagctga

SEQ ID NO: 2603 - DNA, 1614 bp, Unknown
  Description of Unknown: Clostridiales sequence
atgtcagtcaaacatatctttgtcaccggaggcgtggtttccggcctgggcaaaggcatcaccgctgcatccctaggccgcctgctgaaacagcggggtctgcgggttgccctgcagaagctggatccctatctgaacgtggacccgggcaccatgaaccccatccagcatggcgaagtattcgtgaccgacgatggtgcggagaccgacctagatctggggcactatgaacgcttcgtcgatgaaaacctgaccgtcaactcctccgtcacctccggcaaagtctacaccgctgtcctggataaggaacgggatggggagtttttggggcgcaccgttcaggttatccctcacatcaccgatgagatcaagtcccgcatctaccgtatggaaaagggcgagccgaaggacgtcatcatcaccgagatcggcggcaccgtaggcgacatcgaatctctgcctttcctggaagccatccgtcaggtgggccgggaactgcctcccgaggatgtcatgtacatccacgtgtccctcattgtcaccatccccggctccggcgagcagaagagcaagcccacccagcactcctgcaaggaactgctgaccatcggcatccagcctgatgtcatcatgtgccgggcagaccagccggtgaccgaggacatcctgaacaagatcagcatgttctgcaacatccccgtggagaacgccatccccaacctgaccgcccccatcctctatgaagtgcccctgatgctggagaaggaaggcctgggcaacgtagtctgtaagcacctgaagctgaacgtgcccgcccccgacctgaccgagtggaccaagatggtggaacgtgctaaggccaccgtggacggggaagtggagatcgctctggtgggcaagtacgtggagctccacgactcctacctgtccgtggtggaagccctgacccacggcggcattgagaacgacgtgaaagtcaagatccgctggatggactcggagaacgtcaccgaagagaacgtggcagaggtgctggacggcgtcaacggcgttatcgtccctggcggcttcggcgcccgcggcatcgacggcatgatctactccatccgctgggccagagagcagcaggtgcccctgttcggtatctgcctggggatgcagatgtccgtggtggaacacgcccggcacttggccggcatgatcggcgcacactccagtgagttggaccccgaaaccccttatccggtcatcgacctgatgcccgaacagcgggatgtggataaaatgggcgcgaccatgcgtctgggcgcgtatccctgcaagattctgaacaagaactccaagacctatgaggcttacggcgaagaggtcatctatgaacgccaccgccaccgctatgagttcaacaatgactaccgggaagccctcaccaacagcggcctgtccctggtgggcgtgtcccctaacgacaagctggtggagatcgtggaagatatgaaccacccctggttcgtgggcgtccagttccatccggagctgaaatcccgtcccaacaaggcacaccccttgttccgggagttcatccgggcgtccaaggaaaaccgagacaagtga

SEQ ID NO: 2604 - DNA, 1287 bp, Unknown
  Description of Unknown: Clostridiales sequence
gtgaagctctttcccgccattctgctgagcggtctgctggcgctcaccttagccggctgcactgcacagagcacctctggcggcgtctctgctgccgcatctgcccttgacgcaaccgcaaatgcttcccccattcagatcaaactcaaccgggtgaaggatgagatcaaggcggaggacggccatgtgctggtctcctacgcctatgaccgtcccacggtgatgatttccggcaactctgccgctcagtccgccattcaaagcagcttgaacgctctggtggacaaggatttgacctatgtaaaaggagacctttacgccatcgcccaaggaaactatcaggcgctgggcaaggacgcgaccccctgtacctccgagctgaacctgaccgtcacccgcagcgatgacacagtcatcagcctggtggccgatgagatccaggacgccggcggcgcccacggcagcgactggcgcagcggctggaactacgacacggagaccggtcagctgctgaccttccccgacctgggcaacgggttccgagaaaaggccaccgagctggtgtccgagcaggccgcgttggaggtggactctctcttcgatggttatcaggaaaacctgagccacgtggtgctggacggtaccgaggacgcccagagtctgtacggctttgacgccaccatcgcgcctaccttttatatgactgacgaatccatcacctttatctcacgggagtacgaattgcagccctacgccatgggtgtgttggaattccccactccttattcggactatggttccatcctgaaggagcactacctgcccaagggctacaccgccaaagaaagcgccaagcaggacgccgacctggccgccagctcggacgatggcaatactaccagcaacgacgcctctgcggactccaacgggcaagccctggccaaatcgggaaagctccagggaaaaggctggacgctgaccatccccaccaactggagcaagcagatctatgtggccagcaccgccaattcggtctctttctacgagaaagggtgtcatgatgccatgggcggcggctggctgttctccatccagtcctatcaagacaactcctaccagcagctgccggactacgagctgctgagcatcgaccggaccaccacctatgtggtggtctaccccactgacgtgcagttcgagggcgctgaccaaaagagcgctcagcgctacagcgctttttccgggcagatcgaaaaggtgctgaaaaccttcgccctgtccagctaa

SEQ ID NO: 2605 - DNA, 894 bp, Unknown
  Description of Unknown: Clostridiales sequence
atggccttggaagaaaaactctatcagtacctggatcggctcaaagcccgctaccccttggtggcctttatcgtggacgtcatcgaggtctacctggatcgccgggtctcccgcagctccgctgagctggcctattacctgctgctgagtgtcttccccatgctcatcatggtcatctccgccctgggctggctgcatctggagaccaacgcagtcatcagcttcctcaacaccgtcctccccgcccagatcatggagctgttctccgactatatcacctacgtcctcacccaccaatccaagggactgttcctggccggactcatcatgtccatcaccgcctcctccgctggcttccgcagcctcatgtccatctccgccgagatctacggacggcgcaccttccgtggggtgtggtacttgctgacctccctgattttctccgtcctgctgctggtgatggtctacgggtctatcgccgtcgtcctgacaggcaactggttctttaaatggttccggatgcgcttttccatgctgccgctgcccaagaacctgcgctggatgcgcctgatgattctcttcggcgtggccctgctggtcctggctctgctctaccgggtcaccgccccctggagtcaccagcggccgccggtgctgaagggtgccttcctcatctccatcctgctggccgccgcatccggtctgttctccatgttcatcagcctctccacccgctactccaccgtctacggctccttggcctcggtcatcatcctgatgctctggctctacctgtgcggcaacatcgtcaacctgggcaacgtgctcaactacgtgtggtggcgacgaaaacaggggctgccggtgcgcttcctattagaaaagcaattgtaa

SEQ ID NO: 2606 - DNA, 888 bp, Unknown
  Description of Unknown: Clostridiales sequence
atgacctatggcgacgtggaagcctttttggcgattttacgcaacgggagcatcaccgcggcggccgaagcgttgttcatcacccagcccgccctatcccgaaaactgaaatccttggaacaagagcttggtgtgcgcctgttcgagcgcgagcagggacggcactacctgactctgacagccaaggggcaggaatttgcccctctggcggagaagtggatgtccttacaccgggagaccgagtactataaatccggcgacgcccaagccaccctaaaaatcggcgccgtggactccatccacacctacctcctcccacccgtcctccaagcccagctgcggctgcacccagaggtgcgcctgtccttgacgctggtgcatgactggacggcgtacagtgagatctccgagcgcaagtgtgacctggcctttgtggacgccatctactatgccgctcacgtccgttccacccccatgtttcgagaccggatgctggtggtcagccgcacacctttctccgcaaactgtctctctccctcctccctgaactgtgccaatgaggtgtgtgtcagctggacaccggagtttttggagtggcatgattactggtatggcatcagcaatccccccaaggtcagtgtggataaaatgtctctgatggaatatttcctgaccgaaaaggacgcctgggccctcatgccctccaccgccgcccgtgcgttggtgcggcgcggggagtatttctgctgtgagctggacgccccgcctcccgaccgcacctgttacctgctccaggacagcgtgaacaccacaccgccggcagaatccttcttggagaccttccggcaggtgctccgctccaaccccgacctagagtcgctcatctga

SEQ ID NO: 2607 - DNA, 1191 bp, Unknown
  Description of Unknown: Clostridiales sequence
atgaatcccattaaggaggaagttacgatgaaagatacctatatttccgattccgttctgtacgtcggcgtagacgacaagaccatcgacctgttcgagagccagtacgtggtgcccaacggcgtctcctataactcctatgtcatcatggacgacaagatcgccatcatggacaccgtagacccccgcaagaccaccgaagggctggccaacgtagagcaggctctggcaggccgtctacctgactacctggtcatccaccacatggaaccggaccatgcaggcagcatccagcagctggcggagaagtatcccgacatgaagttcgtctccaaccccaagctgtttgctatgatggaacagttctatgacttcgacttccagagccgcaaggtggtcgtcaacgagggcgacaccctggaactgggtcaccacaccctcaccttcgtcatggctcccatggtgcactggcctgaagtcatggtcagctatgagagcgccgagaagatcctgttctccgccgacggctttggcaagttcggcgccctggacaccgaggaagattgggactgcgaagcccgccgttactatatcaacatcgtgggtaagtacggcgccaacgtcatggccctgctccagaaggcagccaccctggacatcgccaccatctgccccctccatggccccatcctgaaggaagacctgggtcactatattggcaagtacctgacctgggccagctatgaaccggaagacgaaggcgtcaccatcgtctacggctccatccacggccacaccgccaaggctgccaagctcatgcagaagatgctggaagaccgtggccagaaggtagagatcttcgacctggcgcgggacgacatggccgaggccatcgagtgcgcctaccgctatgacaagctggtcatcgccaccgtcacctatgacgccggcgtcttccccgtggtggaggactttgtctatcacctgaagctgaagaactaccagaagcgcaccgtgggcatcatccagaacggctcctgggggcctgtagctggcaagaaggtcaaggagtccctggagaccctcaaggacatcaagatcgtcgatcccatggtcaccatccgctccgccctgaaggagggcaacctgaccgctatggaagccctggctgacgccctggtggcaaagtaa

SEQ ID NO: 2608 - DNA, 1362 bp, Unknown
  Description of Unknown: Clostridiales sequence
gtgcatgagaacaaagaacggctgacccgcatcggcaacgccattttatccgcctcccggaacgagctctacctgtccatgcgcttcttcgacctggcgctgagcggtctgggctaccagatgaacctgaacaccgccaccatcgccaccgacggggtgaacatcctctacaaccccacctacttgcagcggcagtacgtggacgacatgatccagctcaaccgcacctacctgcacatggtgctccactgcctcttccgccaccccttccaccggggcgaccgagacccggcgttgtgggacgtggcctgcgacattgcggtggagtccattttggactccatggaggtcaagacggtggccatggtcatccccctgttccgagaggacgtgtacgaccggctgcggcaggagtgcccggtgttcagcgccgagcgcatctatcaggcgctggaacggcagatcatcccctgggaggagcagctggacttttacaaatacttccgccgtgatgaccacaagttctggggcgcccagcaggaggaggaacagcagggcagcggtcaaggggacggcgcgggcgaccaagaccagtccgatgagcggcagaaggagctggaggacaagtggcaggacgtgtccgagaagaccaagaccagcatggagaccttcttcgcccagcacggcaaggaggctgggacgcttctccaagcgttacagatcgagaaccgggagcgctacgactaccggcggtttttgcagcgttttctgaccctccgggaggaggtgcaggtggacccggactccttcgactacgggttctacgcctatgggttggagctgtatggcaacatcccgctgatggagccgctggaataccaagagactcggaagatacacgacctggtcatcgtcatcgacacgtcggactcctgccgggaaggggtcatcgccgccttcctgtctgagacccgcgccatcctgaaccagtccgacctgttcttccagaacgccaacctgcacatcatccagaacgacgcggcagtgcaggtagacacggtgctccacagccgggaggagtttgaccagtttaccaagacgtttacggtgaagggctacggcggcaccgacttccggccggcgttccaatatgtgaaccggctcatcgaggaggggcagctcaccgacctgaaagggctgctctacttcaccgacggttgggggacttatcccaagcatcgtcccccctacgacgtggcctttctctttttccgtgaccaatatcaagataccaacgttcccccctgggccatgaaggtgatcctggggccggaggaactgacggaggtgcatccgcaatga

SEQ ID NO: 2609 - DNA, 741 bp, Unknown
  Description of Unknown: Clostridiales sequence
ccggaacgagtagttgccgccgctgccaagctgtgctactccaaagtgggggtgaccaacctgctggacggcctgacgccggagaagagcgccagctttttgcggatgctcagtgacctgggccatgccagccctgtcgagcacgcatccttcaccttcggcatcgaaggggtgtcccgctctctgctggcacagatcacccggcatcgtctggcgtcctactccgtccagagtcagcgttatgtgcggttggatgatttccattacgttatcccgccggaagtggaggcagagccggaagccaagaagctgtttttggaggccatggaacagcaggcacaggaatacttaaagatcgccggtgcccttcagcggaagcatcaggcggagctgatggcacaggggctgtcggaaaaggcggccaagcagaaggcggagaagctggccaatgaggacgcccgttttgtcctgcccaacgcctgcgagacaaaaatggtggttaccatgaacgcccgcagtctgaaccacttcttcaacctgcgctgctgcaaccgtgcccagtgggagatccgtcggctggcggaggagatgttcaagctggtctatgcggttgcgcccaacttgtttgccggtgccggtcccagctgtgtggcggatgggaaatgtcccgagggcaacatgagctgcggcaagtgcagggagatgcaggagcagtaccggaagtggaaggaagagggctga

SEQ ID NO: 2610 - DNA, 1434 bp, Unknown
  Description of Unknown: Clostridiales sequence
atgaaggggggaaagtggaagggctttcaatttcgccccagcgagaacgtccaatcccagttcgccctgtcctatctgctcatcattgccgccgtcctcatcctgctcaacacctatcccctgctggcctgtcagaccctggtgttccaggccaagcagagcatcctgaccgaagcccagatgatcgcctccaatctggcagagctgggcgagctgggggaatcgggggtggaacaggtgatgacgttggtgggcgacggcaacctgacccgtatcgtggtcaccgacccggacgcccaactgctctacgacacccaggagagcgcccgtccccaccggtacgccctgttccaggagctgacccaggcgctggacgggcaggacgtctatcacgcctcttttcgggacaacgccttccgcagtgaggccgccgtgccggtgacctattgcgggaacatcatcggcggggtctacctttataaatatgacacggagcaggcggagattttattggggctgcaatccaacctgcgcaacatcaccctggtggtctgtgtcttcgccgtgctggtcagcgtcatcctgtcccggatgatgacccggcggatgaacgatctgctggccgccatccgggccttccactcaggcagcgacactcaccccatctcggtgaagggtaaggaccagctggccaagatggcggacgagttcaaccagctcaccgagcgcatccaagagacagacgccatgcggcgtcaattcgtagcagatgcctcccatgaattaaagactccccttacctccatccgcctcctgtccgactctatcttgcaggacccggagatggaaccggagctgatccgagagtttgtgggggacatcggccgggaggcccagcggctgagccgcatcacggaggggctgctgtccctgactcggctggatcggggcattcaggagcagtccggcgtcatcgacgtgtccgggcaggtgcgctatgccatccacctgctgctgcctctggcggaggccaatgacatcgtgctccactctcagttggagtccaactgcctggcgctcatctctggggacaacatggctcacatcgccaacaatctcatcgagaacgccatcaagtacaacgtccccggcggcagtgtgtggatccggctggccattgaccaggatgacgtggtgttcacggtggaggacaccggcatcggcatcccgccggaggagcgggagaaggtctttgagcggttctaccgggtggacaaggctcgttcccgggaggcgggcggcaccgggttggggctgtccatcgtacgcgacacggttttgcaggccggcggctccattcgcctgaccgaggggagcgccggaggcgcttgcttccaggtaacgctgccgctggcacaggaggacgtgacatga

SEQ ID NO: 2611 - DNA, 1326 bp, Unknown
  Description of Unknown: Clostridiales sequence
atgaattctgccaacgaaatttggatgagtatcacaccggtcctgcaagagaaatacaccgccatcgcctttaccacctggttcggccaggtggaagcgctggatttcaagatggaccagctgatcttgtcctgtccctcggatttcaaagcgaagatgattcgagaccgctttcaatccgacatcgaacagatcctccacgacctgttcgccgctgacatcaaggcggtgatcttggggccggaggagacggccgcctaccgctcggaggcggcggagcagcctgcgcccaaccagaacatcctgatgggcagtgaggagtacacttttgaccggttcatcgtgggttcctccaaccggtttgcctacaacgccgcccaggcggtggctaacgacccggggaagagctacaacccgctgttcttatatggcgagtccggtctgggcaagacccatctgctttactccatctatcacaccatccggcaaaatcattcggactatcagatcatctacatcaagggcgacgagttcaccaacgagctgtccgaagccatccgcctacgcagcaccgatgccttccgtcagaaatacagggacaaggatctgctgctggtggacgacattcaattcattgccggcaaggaacagacccaggaggagttctttaacaccttcaacaatctgtacgaggcgggcaagcagatcgtactaacctcggatcgtcccccatctgatatgctccggctggaagatcgtctgcgcacccgattcgaatgggggttgatggcagacatccagccgccggactacgagacccgctgcgccatcatcaagaacaagtccatcctgctggggctgaacctgccctcggatatcatcgagtacatcgcccagaacatcaccgccaacgtgcggcagctggaggggaccatcaagcggctcatggcttatcgggacctgatggacagcgagatcaacgatgagaacgcctcccgggccattcgggagctgatccggaacaaggatgaattcgtgccctcgccggaggtgatcgtggaggagaccgccaagttctacgacctggaccccaagaccatcatgggcgagagccggaaagccaacattgtcctggcccggcaagtctccatgtacatcatccgttccatcaccaaccagtccctgccggaagtgggtaaattcttcggtcagcaccatacgacagtcatgcactcggtggagaagattgaaaagatgctctccacagaccgggagctgaaggaagtcattcgcgacatcaaagccaatgtaaacgaccgcttttga

SEQ ID NO: 2612 - DNA, 1278 bp, Unknown
  Description of Unknown: Clostridiales sequence
ttgaaaccgagtaaatggattccgaagatcgtcatggtcgccttcttcatcggcgccatcctctatttcgtcggctatgccgtacagaccttccgcaacgacatcaccaccgtcaccgtctacgagaccggtgtggaggactccatggacaccacaggcttggtggtccggcaggagacgttgctggaaggcagcggcgagcggatggaggtgctgccggcggaaggggaatcggtggccaaaggcgaggtcatcgcccggatctacaaggatcaggcggcgctggagcagcatcagacgctcaaggccaagcagaccgagcgggaagcgctgcaatacgtgctgagccactccaccgagtcctcggacacggcggagctgagcaagcgggtcatcgcctcgctggaatccattcgatctaccgtgtttcatgaggatctgtccgatctatccgaccagatccagtcggtgaagaacatgatctaccggcaggattatacttacaagggcagcgaagcggtgaccaaggagatcaaccagctgagcaaggagatcaagaagctggagaaggaggcaggcagcacggtctccaccatcaaggccgagcaggcggggaccttctccgccatggtggatggctatgagacggtgctgaacccctccaaattgtccggcctgacgccggcgaagctggatgagctggtcaagaaccggcaggaggttaaggaaggcaagtatctgggtaagatcatcaccggcggcaaatggtactacgcggtgaccatgaatgtggcggatgtggagcggatgcatgaggacatgaccgtgaccgtgcgctttgacaacgtggctggcgagcagaccatgaaggtggagaccatcggggacaccaagggcgatcagaagcaggtcaccgtggtcttctcctccacccgccacctgacggagacttccctgctgcggcagcagtcggcggcagtcatctacgagagctaccggggcttccgggtgcccaaggaggcgctgcggatggaaggggataagtactacctctaccgggtcagcggcgcgcagctgcggaaggtggaagtggagattctgtgccagctggacgactactatgtggtctggcagggcaagtccgtagacaaggacggcaaatcggtgcagcagagcgcactggagaaagcaaagcagattcgggacggcgacaccatcgtggtgcgggggatgaacctgtacgacggaaaagtagtgggcagccgtgcaaagacataa

SEQ ID NO: 2613 - DNA, 1272 bp, Unknown
  Description of Unknown: Clostridiales sequence
atgagtgaaaagaaaaaaacagcagcacccaagtccgcagaggaaaaggaacagaagaatcgcatcccggagcacatctccggcgcggaaaaactgaatgagctgattgagcgagggaagaaaaacggcaagctgaccaccaacgagatgatggaattggacggggtggagctggacagctccacgctggatcggttttatgacatcctggaaaacctgggcatcgccctggtcaccgaatatgagctgcctgaggcagacgagcacgccaccgaggagatcgacaacctgaaaggggagatcgaggagctgaaggcggaggaggtggaccccaacgccatggcggagagcttcggcatcgacgacccggtgcggatgtacctgaaagagattggcaaggtctccctgctgacccaggaggaagagctgaagctggctaagggcatgtctgatggcagcgaggcacagaagatgctggacgcctgggagcgtctgcaaaatccggaggcctatgaggaagaggagccggaggacgacctggacgaagaggaaaacggcgatgaacccgacctggaagcggtgcgcagcttgacccccaacgacatcaaggcgctgaaacggaaggtgcgctatggccaggactgcaagcagcggctggcagaggccaacctccgtctggtggtctccatcgccaagcgctatgtggggcgtgggatgctgttcctggatctgatccaggagggcaacctgggcctcatcaaggctgtggaaaagttcgactacaccaagggctacaaattctccacctacgccacctggtggatccgccagtccatcacccgtgccatcgccgaccaggcgcgtaccatccgtattccggtgcatatggtggagaccatcaataaggtcatccgcgtctcccgccagctgctccaggagctggggcacgaccccacgccggaggagatcgcggcggagatgaatatgtccgtggaaaaggtgcgtgagattttgaagatcgcacaggaaccggtctccctggagacccccatcggcgaggaggaagactcccacctgggtgacttcatcccggacgaggacgcctccgagccctccgaagccgcctccttcaccctgctgaaggaacagctggtggaggtgctgtccactctgacccccagagaggagcaggtgctcaagctccgcttcggcatcgaggacggccgtacccgtaccctggaagaggtgggcaagcagttccacgtgaccaga

SEQ ID NO: 2614 - DNA, 756 bp, Unknown
  Description of Unknown: Clostridiales sequence
atgaaactgatttcctggaatgtgaacggcctgcgtgcctgtttgaaaaaggggtttgaagatgtgttctactttttggacgccgacctattctgtctgcaggagaccaaactccaggccggacaattggagttggatctccccggctattatcagtactggaattacgcagaacggaaaggctattccggcactgcggtcttctccaagcgggaacccttgtccgtccggtacggcctggggattccggagcacgacacagagggacggctcatcaccctggaatttgacacgttctatttcgtctgctgctacacccccaacgctcagaacgagctgaagcgcatcgactaccggatgacctgggaggaggatttgcaggcgtatctgcaggcgctggacaaggaaaagccggtggtgtacgccggtgacctgaatgtggcgcacaccgagatcgacctgaaaaaccccaagagcaatcggggcaaccctggtttttctgaccaggagcgggagaagatgacccagctgctgtcctccggttttacggacaccttccgccacctctatcccggccgcactggcgcctattcctggtggagctaccggttcaacgcccggaaaaacaacgccggatggcgcattgactatttcatcgtctcagaccgactggcgcctcgcatcaccggcgcggacatttacccggagattttgggcagtgaccactgtccggtgggtttgactttagacttataa

SEQ ID NO: 2615 - DNA, 852 bp, Unknown
  Description of Unknown: Clostridiales sequence
atgaatcagccaaacatcagccgattgatcaaaaacctggagagtgagttcggtctgaccttattctccaggacatcctccggcatggtcgccaccagggacggggaactgttcctgatgcaggcggaaaagctggtaaagaacacggacacctttgagcattccttcaagaacagcgaggagacctccacgtcattccgcatcgctttaccccgaggcagttacctgaccaaagccttcgcccggacgttgaacgcggtcactgaggatcatcccatccaggtcaccttcaacgagaccaacaacgaagaggtcatccaatgtgtctctgcccaggggtatgacgtgggcatcatccgactgcccattgagttggaagggaactacaaaaagctgttggctgaaaagcagctgaagttccaggagatcatggtcttccgttttgtggtggccatgcacaaggaccaccccttggccaaccaggaatatgtccacttttccgatctggtgaattacaccgccttggtgcacggtgacaaccatttcctcaccttctctgactcggagaccgataaattataccgcacccacttgtataagaattccatctctatctttgagcgaggcagtcagttcgacttcctccgggacatccccggcaccttcatgctcatctcccccctgccccaggagctgctcaacgcctatgacctggtgcaggtcaagctgccggacagcgagatcgggttgttcgaagatctgatgatcacgcggaaggatcgccgctacacggattttgtacaagagctgatgcaccaaatactcgaagtagagcgtgaaattatggtatag

SEQ ID NO: 2616 - DNA, 1650 bp, Unknown
  Description of Unknown: Clostridiales sequence
atgtctatattggatgtgttcgcgctgttaggcggtgtgggcttgtttttgtatggcatgatggagatgtccagcgggttgaaaaatgccgccggtgacaatctgcgcatcatcctggaaaaagcgacccgcaaccgtgtcgtgtccgtgttggtgggcatcttggtgaccatgatgattcaaagctcgtcagccaccgacgtcatggtcatcggtttcgtcaactccgggctgatgaatctgtcccaagcgctgggggtcatcatgggagccaatattggcaccacggtcaccgctcagctgaccgcttttgatttaggctcatacgcgccgatgatcttgttcgtcggtacggtgatgtatctgttcgtgaaaaaggcgaccatccaatacattggggaagttgtcatgggctttggtatgctgttcgagggcatcaccctgatgaagcaagccatcatcccaatgtcccagaccgagcagttcatcgccctgttggagggcttgtccaacccggcggcggcgctgatcttcggcgtcctctttaccgccctggtgcaaagctcctcctcctccatcgccatcttccaggcttttgccatccaaggcatcctggactaccacaccgtggtctacctggccatcggcgccgccatcggttccgtcacccccaacctgctggcctccctgaccaccaaccgagagggcaagcgcagcgcggtgctgaacctggtgttcaacgtcatccgtgcggccatcttgaccatcctcatcaccatcttcccccagatcttggacttcatccagagcctggcgccccacgacattggccgtcagatcgctcacacccacaccatcttcgccaccctggccgtgctcatcgaactgcccatgtccaatatgatcgtcaagatctcccgtaagatcatccccatcctgccggaagagcaggaaaaggacgagcgctatcgcctggtctacctgtccggcctggagaatatccctcccgccgtggcgctgaagcaggcgcagatggagatcgcccggatgggcagattcgccgaggaaaacctgcagatgggcattgactgcgtcctgcagcgggatgagagcaaggtcaagccggtcttcgagctggaggctgtggtggactatctggacagccagatcacccaggcgctcatcaatatgcgctatcaccacatgaccgataaggagctcaaccgcctgtcccacatgatcctggccgtgtccgatatcgaacgcatcagtgaccatgcggagaacctgacccagtatatgctgcggctgaaggagcagaagatcgacctgtctccggaggcggaaaaggacctaatcgagatgtgccaggccgtcatggccgccacccatatctccatggaggtgttcgccaacgacgactttgaccgcctgcaggaagcagagtggctggagaacgtggtggacgacttggaggagcagtgcgtggacaagcacatggaacgcctgctcaacaacacctgcaacccggtctgcggcgtggtgttctcggatatggtcaccgacctggaacggtgcgcggaccatgcggtgaacatcgccttcgcgctgagcgggaaatcggaaaaacaccatatcgtgaaggattga

SEQ ID NO: 2617 - DNA, 1332 bp, Unknown
  Description of Unknown: Clostridiales sequence
atgaatgtgaaaaacgtagaaaaactggaacacagcatggtccgagtgaccatcgagatcgacgcggacgaatttgacgctgcggttgaatctgtttaccgcagaatgaagaaccagctcaacgtccccggtttccggaagggcaaggctcccagaaagctggtcgaaaagatgtatggcgccaacctgttctatgaagatgccgtcaacgagatctgccccaaggcagtggaggacgcagtggatcaggagaatctggagatcgtcggctatcccgaaatgcacgtggaatccgtcggccccgaaggtgtcatcgtcaatgctgacatcgccgtcagacccgaagtcaccgtcgagaactacaagggcatcgtcgctccctacaaggacgtcgaagtgaccgaacacgacgtggacgtggctctgactccctatatcaaccgcgcaaagaccaccgtcgaagtggatcgcgaagcggctaaggacgacaccgtcgtcatcgacttcgtcggctacaagaacggcaaggaatttaagggcggcaaggcagaaggttatgagctgaagctgggctccaactccttcatccccggttttgaagaacagctcatcggcaccaaggccggcgacgagaaggaactgcacctgaccttcccggcagactatgcccagaaggagctggctggtgctcccgtggtcttcaaggtcaaggtcaacaccgtcaagaccgtgcaggaacctgtcctggacgacgaatttgccaaggacgtcagcgaatttgacaccctggaagccctgcgcgatcacctgcgggaagagtgcaagaaggaccaggaagagcgcgctcagaaggaatttgagtatcgcgtgctggagaagctggtggagcagactgaatttgatattcctcccgcaatggtggactatgagagagacagaatgctcaacgagtacaacagcaacttcgcaagcagcggcatgagcctggagcagtacatctccatgaccggcgctaccgtgcagcagttcttggactccctgcgtgaggacgctctgctgaacatcaagaagggcctggtgctggacgccatcgcaaagcaggagaacgtggaagtgaacgacgaggatatcgacgcttacgcaaccaagctgggcgaaggctatggcatgagcctgaccgagatcaagtccgctgtgcccaccgataacctggaaggcggcgcccgtgtggataaggcagcccgcatcctctacgatgcagccatccatggccctgccgaagaggaaaagaaggaagaagctgcggaaaagaccgaggacgcagcagaataa

SEQ ID NO: 2618 - DNA, 609 bp, Unknown
  Description of Unknown: Clostridiales sequence
atggatccagcgttacagagcgcgttagtggaagccgtccaatcggtggccacccccacctgggcagacatcgccacggccctcatcgcctttctcgccctcatcggaaccatcgtcatggcgttcctgcaaaaccgcatcgccaagcagcagaccatcatcgccgccaagcaggcggatatcgccgaccagcagaacaagatcgcccttttcgagaagcgctacaccctctacgaccaggtggggcggtgtaccaccttcgccttcctgctggaggagttcggcactctggagaactttttgtggctgtacaaggccgccttcgccgacacgggccggaccgatcacaatgtgtccctggacgacgtgatggagctgaaccggaagactctggctgtcacgaagcaggcggactatctgtttggcaaggagctgagcgagaagattgccgggttatgtgcccgcctggtgctgttggtgtccttgatggagttcccgcaggccgaccaaacggtctacgcggatcggaaggagagcttttgcacctacgccagagaatttgaagaacaacatatgccactgctggaagcccggctcaatatcagataa

SEQ ID NO: 2619 - DNA, 768 bp, Unknown
  Description of Unknown: Clostridiales sequence
atgaaagcatttcagtacacttgtaaagcaaccctgggtctgcacgcccgtcctgccgccatcctggctacggagtgcaccggtttgaagagtgcggtgaccattgaaagcaacggaatgtccgcatccggcaccgacgtgctggccatcatcgccttgcgcgccaagaagggcgacgttctgaacatcaagatcgaaggcactcccgaagaggaggagcacgattatgcaagactgcaagaggtcttcgcccatatcatccccacggacaacaacctgaacgtgttgaaggtggccttctacggcaccaaatcctatgacaagatcttctttgaagagctggccaaggacaagggcgagggcgcttacaactgcgatatcacctattttgacagccgcctgaccgccgagaccgtccacctgtgccgtggctttgacgcggtgtgtatgttcgtcaacgacgaggcgccccgggcggtggtggaacagatgaagaagaacggcatccgcctcattctgctccgctgcgccggcttcaataatgtggatctggacgccgctaaggaatgcggcatcaccgtcctgcgtgtgccggcctattcgccctatgcggtagcggaacacgccatggccatcctgcaggccgccaaccgccgcatcaccaaggcgtacaacaaggtgaaggacaacaacttcgccctgaacggtctgctgggcaccgacctgcacaacaaggtggcgggcatcgtcaccactggccgcatcggc

SEQ ID NO: 2620 - DNA, 1479 bp, Unknown
  Description of Unknown: Clostridiales sequence
atggaaagagtagcagaatccctaaagagcaaagtgatgtcggcacagcaggcagcacagttcatcaagtccggcatggtcctgggcatcagcggcttcaccagcgtgggcagccccaaggcagtgcctctggctctggtggaatccggccatgcaaaggatctgaccatcagcgttggtgcagcagtcagcgatgaagtggacggcgccatggttcgtgccggtctggtctcccgccgtttcggccaccagtccaacagcgacctgcggaaggcgatcaacaatggcacgatcgagtttagcgatctgcacatttcccacctgcccatgaacatgaagcaggactgcggtctgcacaccaatgtggcactgattgaatgtaccgctgtcaccgaagatggcctgtacctggctgcttcctgcggttcttctgacgcagctgtcgcttccgctgacatggtcatcgtggaagtcaacactaccctgccggaacagctgatgggtatgcacgacattttcgagattggtctgccccccgaggcaaagatcatccccatcaccaagcccgatgaccgcattggcaccccctacgttccctgcgaccccgacaagatcgtggccatcgtgatgaccgaccgggaagatccccctcagaagttcaagccctccactcctgtcaccgacaagatcggcgaaaacgtcatcaagttcctgaagggcgagatcgaagctggccgtctgcccgcaaatcccggccccatccagtccggcgtcggctccgttggcaacgctgtcctgggcggcctggcaaagagcggcttcaagggtctgaacatgtacaccgaagtcatgcaggacgccgcactggatctgctggatcagggtgttgtgaagtttatctcctccagttccatcgcgctgactgcggattatcgcaagcgcttctatgataacatcgactactatcatgataagatcatcgtccgtccccaggagatcaccaaccatcccgagactgcccgtcgtctgggtctgatcgccctgaacactcccatcgaagtggacatctacggcaacgtcaactccacccacatcatgggcaccaagatgatgaacggcctgggcggcagcgctgacttctcccgcaacgctcgtatctgcatctttgccaccgaatccatcgccaagggcggcgacatctcctgcatcgttcccatggtctcccacgtggactccaccgaacatgacgtggacgtcatcgttaccgagcagggcattgctgacctgcgttggaagtctcccaagcagcgggcaaaattgctcattgaaaattgtgcacatccggattatcgtcccatgttgcgggaatactttgaacatgcctgcaaggtctccgctggtcagcacactccccacgacctgaagctggctctgtcttggcaccagaactatctggaccacggcaccatgaaaaagtaa

SEQ ID NO: 2621 - DNA, 1203 bp, Unknown
  Description of Unknown: Clostridiales sequence
atgaaacgaaagaaatccaccggcgggaagaccgtccggcgtctggtggcgctctctgcggcagcggctaccatgtggacggtgggtcagacggcagactgggaggcggtggcccacagcggcacccagctcatccagagcgcggcgtgggcggaacgactggtgcgacaggagctgatccggccgttggaggaggggagcggcgtggtgctcaccggctgggaggagctggtggtggcccagtcgcctgccttgctgctccagcgggcggcgctgaaggaggagggcagtttggactccgaccttgggcggaccaagcgggaacaggcggcggagacagccaaggaacggaagcaggaggagtcaaaaaccacccaaaagaaaacgaccaaagccaagcggaaggagaagaagtccaccaaagccaccaagaagctggacacatctaagttaaaggtagctgacatcaacttggacaaccacaccaaaggcatccaggtgaatctcaaggactactttgacaaaaaacttaacttaacgttacagccggccaagaaaggccctcagattttgatcgtccacacccacaccactgaggcgtataccaagggaaagaaggacaaatacgaggagaccgacccagcgcggacgctgaacaacgattacaacatggtgcgggtgggggaagagatgaaagctgtttttgaggacatggggctgtcggtggtgcacgacacctccaagcacgactaccccagctacaacggctcctacgcccacgcgctgaacagcattgagaaatatgtgaagaagtaccccaccattcaggtggtgctggatgtccatcgggacgccatcatcgacagcaaaggggtcagctacgccaaacgtaccaagatcaacggcgagagcgtggcccaggtgatgctggtggtgggcaccaacgatatggggctgagtcaccccaagtggaaggatcacttggcgctggcggtgcagatgcagaagaagatgctggccatcgacaagagcttcccccgtcccatcgacctgcgcagtccccgcttcaacggccacgccactcccggctccatgctggtggaggtgggcaccagcgggaacaccctgcaggaggcgttggctggggcgcggtactttgcccgagcggcagggggactgtatacatcctgtgtgaagaagtga

SEQ ID NO: 2622 - DNA, 1848 bp, Unknown
  Description of Unknown: Clostridiales sequence
ttgagacagaaaagcaaccaccgagattatgtattctatctgatcctcctgttggctctgctggggttcttctggttcttcaccaaccagcacagcaccgccagcgtcccctacagccagatggtggagctgttccagtcggaacaggtgtcctccttcacggtgcagaacaatgtggtgaccatggagctgaagtcggaagtagatggcaagaaggaggcttcctgcgccatctcggactttacggccttttatgaggatctcaatcccctggtgcaggcgcagaaaaagagcggcgtgctgaccagctacgactataaaaaggacacccagtccgtcaactgggtcactctcctgccctccctgctctctgtggccatggtcttcctgctgctcatgatgatggtgcggcagaacaacgccaacggcggcggtggcggcctgtcccagttcggcaaggccaaattcacctccgcagaacagatgaagaagaaggtcagcttccgtgacgtggctggcgcacaggaggaaaaggcagagctggaggaagtggtagacttcctcaaagaccctgaaaaatacaccgctctgggcgcacacatccccaagggcatcctgctggtcggccctccgggcaccggcaagaccctgctggccaaagcggtggccggcgaagcgggcgtgcccttcctgtccatctccggctccgactttgtggagctgtacgtgggcgtaggcgcaagccgtgtccgcggcctctttgaagaggccaccaagaccgcaccctccatcgtattcatcgacgagatcgacgcggtaggccgtcagcgcggcgctggcctgggcggcgggcacgatgaacgggaacagactctgaaccagctgctggtggagatggacggctttgagggcaactccggcgtcatcgtcctagctgccaccaaccgggtggacatcctcgacccggctctcctccgtcccggtcgttttgaccggcaggtctacgtaggtctgccggacatccaggggcgcaaagaggtgctccaagtccactcccgcaccaagccgttggccgaggacgtaaacctggagaccctggccaaatccaccagcggcttcaccggcgcagatctggagaacctcatgaacgagggtgcgctgctggctgctcgcaggaatcagcggttcatcaccatgtccgacctgcaggagtccatcattaaggtcatcgcaggcccggaaaagaagagccacgtggtgacccctcacgcccggaagctcaccgcttaccacgaggccggtcacgccatcgccatgcacgccctgcccacccatgacccggtgcatcagatcaccatcgtcccccgtggtcaggccggcggcatgaccatctccctgccccaagaggaccgctccttccgctctcggaacgagctgttcgaggacatcgttgccctgctgggcggccgtgtggcagaggagcagttcctgggcgacatttccaccggcgcttccagcgacctggagcgtgccaccgctatcgcccacgccatggtggccaagtacggcatgagcgacgccctgggcgctgtggtctacgacgacggcaagggtgaggtgttcatcggccgttccatggcacagaccaagccctattccgagaccatcgccgcctccatcgaccaagaggtcaaggcgctcatcgacaaggcttacgcccagtgccgaaagatcctgtccgactacgccccccagctggagaccaccgcacagtatctgctggagcatgagaccatgtccggcgaagcctttgaggcagtgttcactgcaacggaacaggacgcataa

SEQ ID NO: 2623 - DNA, 981 bp, Unknown
  Description of Unknown: Clostridiales sequence
atgagcaagaaaatcaccgtcagcaaggccatcggcgaagccctgcacgaggaaatgctccgagatgacaagatgttcatcatgggcgaggatatggctgtgatgggcaatgtgttcgccattaccaagggctttttggaagagttcggccccaaccgcgtcatcgatacccccatctccgaagagggctttgtgggaatggccgtgggtgctgccatgcgtgggatgcaccctgtggtggagctgatgtatgacgatttcgccaccgaatgtgccgaccccctgttcaaccaggcggcaaagatgcgttacatgaccggcggacagtgcagcgtccccatggtgctccgtgcgcccatgggctccggccgccgcaatgccggtcagcactctcagtccctggaaaacttcttctgccacttccccggtctgaaggtggtcgcaccctgctccgctgaggacgccaagggtctgctgaagactgccatccgggacgaagaccccgttgtgttcctggaacacaagctgctgtacgcccacaaggaagagatccccgaaggagagtacaccattcccctgggtgaagccaaggtcaagcgggaaggcaaggatctgaccatcatcacctggtcccgtgaggtcaatttctccctggaagcggcggaaaccctggcacaggaaggcattgatgtggaagtgctggatctgagaaccctgatccccttggactgggaagccatcaaggcgtccgtctccaagacccatcgcgccatcatcgtctccgaagaggtcaagcgtggcagctatgccggtgagatctccgcgcagatcgccgaagagctgctggacgagctggatgcaccggtggaacgagtgtgcggtctgaacatcgtctctcccttcagcccggtgctggaggatcagaacttcccccatccggctgatatcgtcgccgcggtcaagcgcgtgctcaacaagtaa

SEQ ID NO: 2624 - DNA, 1380 bp, Unknown
  Description of Unknown: Clostridiales sequence
atggaagacgcaaaccgactgccgcgccagccggcggcaaacacccgtgagctgctgaaaaacaccctgggcatggcatggcctgccgtgctggagagctttttcattgccctggctggcatgatcgacgtgaagatggtcagcaacctaggcagctacgccgtagccgccgtggggctgaccacccagcccaaattcctgggtctggccttcttcatcgccaccaacgtggctctgtccgccctggtcgcccgacgcttgggcgaaaaacggcgggaggacgccaatcaggtcatgctcaccgctctggttctatccatcctggtctgtgccgtcatcagcaccctctgcgtcaccctggccgatcccatcatcgacctgtgtggctcccagccggacacccatgcggcagctgtgacctatttccgcatcatcatgggcggtatcctcttctctgtggtctccatgaccatcaacgccgccctccgtggcagcggcaacacccgcatcgccatgaccaccaacgtcacctccagtgtcctgaacatctgcggcaactacctgctcatcgaaggccactttggcttccccgccctgggcatcgccggtgcggccatcgccacggtctttggcacggtggtggcctgcggcatgagcctcttctccctgcgtcatccggacgggttcgtcagcctgccccatatcctcaagactaaaattcgcccagcttggaaatcggtgaaagagctgttccacctgtccgggaacattttggtggaaaacctgctcatgcgcgtgggcttcatcgccaccgccctggtggccgcctctctgggcaccgatgccatggccgcccatcaggtgggcatgaacgtgctgaccatcagcttcgccttcggtgacgggatgcaggtggcggcagtggcgctgacgggacgcagcttaggcgaggggcaaaaggagatcgccaaaacctatggccacctgtgccagcgcatcggcatcaccatctccctcatcctcgccatcctcttcgtggtcttcggccgctggttctatggcctgtacttcccggacgaaccccacatcgtggagtacggcgtggagatcatgcgcttctccaccctcatcaccttctttcagatctcctcggtcatctatatgggctgcctccgcgccgccggtgacgtgaaatataccctcttcgcctcggtcaccagcatcaccgtcgtgcgcaccgccttcacctgtctgctggtgctgggcctgcactggggactgaccggcgtgtggctgggtgtgctcaccgaccaggcctgccgcctcatcctggcctatgtgcgattccggcaagggcactgggtggatttgaaaatttga

SEQ ID NO: 2625 - DNA, 948 bp, Unknown
  Description of Unknown: Clostridiales sequence
ccctatcagctctacgtcaaggacaatcaggcgtccctggtctccctggccaaggagatgggctaccacaccaccgccttccacccctacctgtcgtccggctggaaccggcccctggtgtataagtacatgggctttgacgaccagatgttcgacaccgacgtgagcaacccggagtatgtccgcggctatatctccgactcctgtgacttcaagaccatccagtccatcaccgagcgggggaagggacagaagaacttcatcttcaacgtcaccatgcagaaccacggcggctacaaccagggctggtacaacctgccccgaaccatcgccttgaagggcaccatgttcggcacaagcagctatacagagcagtacctggcgctcatgcgcaagacggacgacgccctgaaggagctgatcgactactatagcaaggtggacgagcccaccatgatcgtcctcttcggcgaccaccagggcaagctgaccactgccttctatgaacagctgttcggcaagagcacggacagcctgaccatggaggagacccagcgggagtacgtgacgcccttcatgatctgggccaactacgacatccccgaagcggagaacgtcatgctctccaccaactacctgggcgtcctgaccgccaaaatggccaacctgtccatgaccgactacatgaagtacctggcggacctgtacgagcagatcccggtcatcaacaccaacggctacatcacgccggatggcaagatgaccgaagaactgtccgacctgtccgagaccttgcagagccaggtgaagcagtaccaagccttcgccttctgcgacctgttcagtcgtttcgactacatggacggcagcttcttccgcctccacccgggcagccaagacaccgccaccggcggagccagcagcagcggcagcgccggaagtgaataa

SEQ ID NO: 2626 - DNA, 1089 bp, Unknown
  Description of Unknown: Firmicutes sequence
ggattaaaaatgaataatatgtttggtttagaaatggatcaattagcaaaaattaaagtaattggtgtagggggaggcggctgcaacgctgtaaatagaatgattgaatctggactaaaaggtgtcgagtttatcgttgccaatacagatcttcaagtattaaacaattctttagctccaatcaaattacaaataggaagagaactaactgacggtctaggtgcaggtgctaatcctgaaataggaagagaggccgctctagaatcaaaagcagaaatagaagaagctatcaaaggtgccgacatgatatttgtaacatgtggaatgggtggtggaactggtacaggtgctgccccagtaatagcagaaatatcgcaagatttaggagctcttacagtaggaatcgttactaaaccatttagctttgaaggtaaaaaaagaatgagtcaagcagtaacaggcttagatgaattaaaaaaacatgtagacacattaatagttataccaaatgatagattaagagaattaattgataaatcaactccaatgttagaagcgtttagagaagtagataacgtattacatagaggcgtacaatcaatctcagatttaatagctgtatcaggattagtaaatctagattttgctgatgttaaagcagttatgaaagataggggaaatgcccttattggaattggcgttggatcaggtgaaaatagagctgtcgacgcagcaaagcaagcagtatcatcaccactattagagacatctataaatggtgcaactgatgcaatcattaatgtaacaggtggttcttcactaacattattcgaagttgaggaagctgctgaagttattagaactgctgctaacactgatataaacacaatatttggagcagtaattaatgaaaacttaaatgatgaagtaatagttacagtaatagctactggttttgaaaatcaaagcgaaccattatatcacagctttaactcaacaaacagagaagaaatctttagagaaggaacagatgatattgataacgacttagatatcccacctttcttaagagatagagataattattaa

SEQ ID NO: 2627 - DNA, 831 bp, Unknown
  Description of Unknown: Firmicutes sequence
gtgataggaatgccagaattaccagaggttgaaactgttaaagaatctttaaaacttcgattaaataaaaaaaagataactaaagctagagttttttgggataatatcatcgcatatcctaataaagatgaatttattaaagaaattactgaacaaactattaacgatgttaagagacgtggcaagtttattatatttgatttagatgatttctatttgctgtcacatcttagaatggagggaaagtacttctttaaaactaaaaatgatgaaattaataaacatgaacatgtaatatttgatttggatgatggtactgaacttagatacatggatacaagaaaatttggtaaaatgtatcttataaaaaaagatgagattgataaaaaaggtcccctgatagaacttggtttagagccatgggatgataaacttaatagtaaatatcttctagaaaaatataaaaataaaaaattacctattaagagtgtactattggatcaaagcgttattgttggaataggaaatatttatgctgatgaaatattatttttatgtaaaattaatcctttaagaaaatgtaatactattactgaaaaagaggccgctaatatcattaaatttactagaaaagtattagaagaagctattaagatgggaggtactactattaggacatatagttctgtagatggagtacatggattatttcagcaagaacttcttgtacatggtaaagataatggtatttgtcctgagtgtcatagtaaaatacaaaaaattagagttggtggtagaggaacctactattgtgaaaagtgtcagaaataa

SEQ ID NO: 2628 - DNA, 927 bp, Unknown
  Description of Unknown: Firmicutes sequence
atgatagtacctagcagtagatactatctaaaatgcccttatgaaatgacacctactcgtattgtagtacataataccgctaatgatgcttccgctagaaatgaaataacatacatgacaaataacgattatgaaacatctttccactatgctgttgatgacaaagaaatagtacaaggaatagaagaaaatagaaatggctggcatgcatctgatggtaatggtaaaggcaatagagagggtatagctattgaaatctgttactcattgtctggtggtgaaagattcattaaagcagaaaaaaatgctgtagacttaatcgtagatatattaaatagatataattggaacatagataaagtaacaaaacatcaggattatactaacaaatattgtccacatcgcacactagatatgggatgggatagattcctaaatatgataaaagaaaaattaaatgaaactagagaaagaccatttataataggagatataatatataatactagtgatttatatttacatgaaacagcaggttacggcggcaaatcaatgctattaaaaaaaggcactaaaggggtagtaaagaaataccattacaacaatggtctatacatggcattaggggacgcaacttcatattatgatgccgcttggacaaatgaatttgaaaagtttacaaaaaaagccccagaagaagaaaaacctagagttcaagaagaaaataaagaaacaagtgtgagaaatgataaaacagaaaaaaatgataacaacaaagtccaagagcaaaataaagatacaacaagagaagaaaacaaagagacagaagaactactagataatcaagataaaagagtaaatgccttactttggctagtagataaaataatattattcataaaacaagtattcagaaagaggaaataa

SEQ ID NO: 2629 - DNA, 984 bp, Unknown
  Description of Unknown: Firmicutes sequence
atgaaaataaaaaattttataaaagaaaattacaaatttttaataacactattaattctagtaatatgcttatatataaaattaccatattatgccatggctcctggaggaacaataaatataaccgacagggtagtaatgcagaactatgataaaaataaagatggtagtttaaatatgctatatgtaagtgaatatgaattaactcctggaacatatatagtagccaaattaaaacattgggatatcgaaaaagaatctacaagaagaatatctaacgaatcaacagaagaagtaaaagaaagaaacaaaataatgcgtgataattctttagatatagccactatggtagcatatacaagtgccaacaaaaagatagatataaagaaaaaaacaaatattgtaatagccactactaaggaaaacggacttaaagttggtgacataattttaaaagcagacaatatagaatgcgaagatattaaagaaataaaacaaataatatcatctaaaaatatagatgatactgtagaatttaccattttaagaaataataaagaaatgaaagtaacaagtaaaatatctaatgaaaacaatactaaagcagtaggcgtaataataataacagaatatgaatatgaccttgatccaaaagtagatataaaattcaaaagtagcgaagccggagcctcaggtggattaatgctaacattaacagtatataacgctataagcgatgaagatatcataaaaggaagaaatatagcaggcacaggtaccatttccgctgatggttcagtaggagaaatagatggtataaaatataaaataatgggtgcagccaaggataaaatggatatcgttttcgtaccatccgccaattataaagaagccatagaaacaaaagaaaaatataattataaattaaatataattaaagttgataattttaatgaagcagtagactatttaagaaataattaa

SEQ ID NO: 2630 - DNA, 858 bp, Unknown
  Description of Unknown: Firmicutes sequence
atgattgaaattaagaaacattattataatattggtaataagaatattaatattatgatgtttggggatttacattattctgataggtttaatgataagaaacttgatttgattagtagtaagatgggtgatgctcaatatctttgtatagcgggagatttgattgatagtacggattttctatatactaataaggatagaaaaaataggattacttcttttattagggatattagtaagaagtgtaagatatttattactttgggtaatcatgatattgctgatagaagtcatggtaataatgtacgtgatgataatgatgagttttggcgtgaattatctaaaatagataatgtgtttgtatctagatataattgttattatgaagatgataatgttattatatatatgttagaggctgattatgattattattatagggattatatgaaagaagctaaagatatattacttaataaaattaaagaagataagaagctatttgataatatggataatgataaagttaagattgttatatgtcattctcctatatatatgactgatagtgatattttaaatgaatttaaggattttaattttatattttgtgggcatatgcataatgggatgattccctatttatgtgataaaattattagaaataataggggaattgtttctccttatggaaagttattttctaataatactagaggtactattgatattaataatattcatttaattataaatggtggtattactaagttatctaagtcttcaggaatatttagttattttaattttatatatcctattagtttggataatattgttattaatagaaaaatgtag

SEQ ID NO: 2631 - DNA, 1068 bp, Unknown
  Description of Unknown: Firmicutes sequence
atgaataggataatttcttttccacatcttggtaattattatattgcttttgaatattttttatctaatgctacaaaatgtaaagtcattgtacctcctgatactactaaaaaaactatagaacttggtgctaaatattctcctgattttgtttgtgtaccatttaaatataatttaggtaattatattgaagcacttgaaaagggagctaatgttcttattcaaggtggaggaggatgtagatatggttattttggtgaactagaggaaaaaatattgagggatttgggatatgattttgagttttataacatgatagaagataatcatatttctttaagaaagggatataaattttgtaaaatgatgaataataaaattaatccttttaaatgtttttattatttatttaatactttacttatgattatttttattgataaaattgagagatatattagacttaatatgggttttgagattaataagggtagttttgaggaacttgaaaaggaatactttgatagttttaaaaataatggtatttttaagaatatttatttatattttaaatataaaagaaagtttaaaaatatttctattaataaagagactaatcattttaaagtggctattctgggtgaattatattctcttattgatactaatacttcttataatacggaaagaaagcttattaaaatgggaatagaggtatatcgtgatacagatcttacttatttacttattactaaaaggtttaaacttcataaaatgataaaaagtggaaagaaatatattaggtatcatttaggagcggatgcttcaggaagtgttgtaaaaagttattgttatgctatgaatggttttgatggaattctccatttaaagagttttggatgtactcctgaaattagtgctatgaatattttaccaattatttccaatgaatataaaatacctatattgtattttagttttgatgccgaggataatgaagtcggtattgatactagattagaggctttttatgatatgattaagcagaaaaaagaaacaaaaacatag

SEQ ID NO: 2632 - DNA, 831 bp, Unknown
  Description of Unknown: Firmicutes sequence
gtgagtgatattatgttctctttaaaaagcattaaaagatattttagtaagcttattaaaattctaagtttaaaagaacttagaattttacctgcctacttatcatatagttttgttttggctgttattcctattgccactattattgttatagtggctggttatttttcgatatctattgatagtattattaatcttattaatgaatttttacctagttatgctagtgatattgtagtgggagttatttctggtaaggattttgatatttcagttggtgttttaaatatttttacttttattgccgctgctaatggtatgtatgctattgttagtgcttctaatgatttgtataaaattgaaaattcttcacaaattaaagatagatttagggcttttataatactacttattattattagtgcaattcttttccttatcttggtacctatgcttggtgataagattatattacttttaggaagatatgaatctttgaataagatagtggaaaatatactgcttatatataaggctgttaaatggcctattacattcttatttattttctttaatattagacttatttattctattgctccttcatatagaattgataagagtagtactactttaggagcttttattactactgttggctgggttattgctaccgctatatttagttattatattaaatattttgctaaatatgatttaatatatggtggtttatctagtattattatgcttcttatttggttttatattttgagctttattttgatacttggtattgttattaattctacggagtataataagaagtaa

SEQ ID NO: 2633 - DNA, 1191 bp, Unknown
  Description of Unknown: Firmicutes sequence
atgaaaattattgaattaacagaaacacaatttaagaattattctaagttacatagttctagaaattattttcaaactatagagtatgctaatattatgaataactataatagattatttttagggtttattaacgaaaatgataatactattatgggagctgttttattacttgaaagaagtgttcttaaatttaaagtgggatatgttcctggaggttttcttattgattatgataacgataatttattcagagattttattactagtcttaaaaattatttaaaagaaaagaaatttgtttatttaactactgataataaaactacatataaaatgtttgataaaaaaggacaagttatttattttgatactaatattattaaattgctagatgagctttcttttgttaaaactaatagagtaagtgaaagaaaagttgttttagaaactgaaaaaactcctgatgaaacttataaaatgtttaattctaatactaaaaggaatattaaattagctcttcaaagatctattaccatatataaagatgataataatagtattgatacattgcttaatcttaataataaattaaacaatgaagaaattaagaaaattattgataactttaatggtgatgttaattcgtctgaaatttattttgctaagattaatcctgaacaatatattaataattatcgttttcttttgaagaaagaggaagaaagaaattataatttgagtcaaattatgcaaaatgctagggctaaaaagagtgatgctttggtaaataagaaaatggaatctgatagacttatttctaaatataataatgaaattattaaggccactaatatttatactaaatatccagaaagtgtaataattggtgctatattaattattaaaaataatcgtgagatatattttatgaatgaggcttttaatgaagaacttaaaggtttttactcttctcatttaattaaatgggaaattattaagaaatatcttactttgggatataaaatatttaactttggtaatattaaaagtatggataaaaaagatggcgactatttatttaaaatgggatttggtggcaaggtatatgaatgtcttggtaattatgatcttattattaataaatggttatatcatattattaaaattattaataatttaaaaaaatag

SEQ ID NO: 2634 - DNA, 942 bp, Unknown
  Description of Unknown: Firmicutes sequence
atgagtaagattgttattgctttaggaggtaatgctttaggtaaaagccctcaagaacagttaacacttcttaagagtgtggctacgacgattgttaatttagttaaagagggaaatcaaattgttcttacacatggaaatgggccacaagtgggacagatatttctagctatggactattcttcaaatggcgatgctggaactcctaaaatgccatttcctgagtgtggaagtatgagtcaaggttatataggttaccagcttcaacaatgtattcaagatgaactagaacatcaaggcattgttagagattgtgcaaccttgataacacaagtcttagttgatccaatggatagtgcttttaataatccaactaagccgattggaatgttttatagtaaagaagaagctatgaaaattcaacaagataaaggttatatatttgttgaggatgctggacgtgggtataggggagttgtaccatctccgaaacctaaggatattattgaaaagaatgttattaaacttcttgttaataataataatattgtaattgctgctggtggtggtggaatacctgttattaaaacagataaaattgaattacttgaaggtgtagaagctgtaattgataaggataaaacagctgctttgcttgctaatttaattgatgcggatatgcttttaattcttactgctgttgataaggtatgtttgaattataatactgataagcaggttgaacttgatactatgaatgtagaagaggctaaaaagtatattgatgaagatcaatttgctaaaggaagtatgcttcctaaaattgaggcttgtatatcttttgtagagaattctgataataagaaggctattattagttcacttgataaggctagcgatgcaattaatggtaaaaatggtacaattataaagaggaggtaa

SEQ ID NO: 2635 - DNA, 729 bp, Unknown
  Description of Unknown: Firmicutes sequence
atgttagaagttaaaaatttgaaaaagtcttttgataataataaggtattaaaaggaattgattttaaggttaataagggtgatattgttgctgttattggtcctagtggttgtggaaaaagtactttccttaggtgtcttaatatgatagaaagacctactggcggtaaggttatttttgagggatatgatttaactgctggtaatgttaatttgcctaaaataagagaaaagattggtatggtgtttcaacaatttaatttatttcctcatttgacagttattcaaaatattactttagctcctattaaacttggtattatgagtcaggatgatgctaataaaagagctgtagagttgcttaaaactattaatttgcttgataagaaggattattatcctaatgagctttctggtggtcagaaacaaagagttgctatagttaggtctcttattatgaatcctgatattattttgtttgatgaacctactagtgcacttgatcctgaaatggtgggagaggtacttgatcttattcgagatattgctgataagggaatgacaatgattattgtttctcatgagatgaattttgttagaaagagtgctaatagacttgtatttatggataatggtaaaatatcttttgatggaagtgtaaaggaaggctttgctaataaggataatgagaggcttaaagaatttttatcaaaaactaaagataaatag

SEQ ID NO: 2636 - DNA, 525 bp, Unknown
  Description of Unknown: Firmicutes sequence
aaaatgaaagtagaaaaaataatagttggaagttttaaagaaaattgctatatcctaagtaatcaaaatgatgtactaattattgatccaggcgatgagccaactaaaataaaagaagcaattggaaatagaaatatattaggagtactaataactcataaacactttgatcatgtaggagctttaccattctttaaagaatacaaagaatattcaaatgaaaatttaaaggaacaagaatatagtatagggccatttaatttcagcgtaataaaaactcctggtcataaggaagatgctatatccttctattttgaaaaagaaaaaatgctcttttctggtgattttcttttttatgaaacagtaggaagatgtgatttgccaggaggttcaatagaagatatgcaaagaagcatagataaaataaagaaatatcctcacgatataaaagtatatcctggtcatggtattagtacaacacttgaacatgaaattgaaaacaatatatattttagggaagagtaa

SEQ ID NO: 2637 - DNA, 1182 bp, Unknown
  Description of Unknown: Firmicutes sequence
atgaaaaaaacaataaaagattttgatttagaaaataaaagagtaattattagatgtgatttaaatgttccaatgaaagatggagtaatacttgatgatacaagaattaaggccagtgttagaaccattaagtatgccataagtcatgaagctaaagtcatactactgtctcatcttggtaaagtaaaaactctagaagataaaaaagataatagtttatatccagtagcttttgccttatcaaattatctaaaatgtgaagtgaaattttcttttgatactaaaggtaaagaacttaccgaaatggttaacaatttaaaagctggtgaagtattactagtagaaaatacccgctttgaagacatagaaggaaaaaaagaatcaaactgtaatcttaacttagcaaagtattgggctagtctaggagatatatttattaatgatgcctatggtagttgtcacagaaatcatgcttctgtgaccggaataccaaaatatttaccaagtggtgtgggatttttagtagaaaaagaaattaaaaaattagataatatcttaaatagtagtactcatccatttatagttattatgggtggcaaaaaagtagatgataaaatagttttgatagaaagattattagaaaaatgtgataaacttctaatagggggagcaatgtcttttaccttcttaaaagctaaaggatacaatactggaagctctatcgtaagtgaggataaagtagaattcgctaagagaatgttagaaaaatatccaaataaaataaacttaccaagtgactttgcagttttagaagatgataaagtaataataaaagatattgaagaatttaataacaaagatatcggttacgacattggaaataaaacactaagaaatttttataaagatcttagtggtgcaaaaagagtaataataaatggacctatgggaatgtttgaagatactcgcttcacaaatggtacaaataaattactaaaatatctagataaaaataaaattaaaactcttgtagggggaggagatactgcttcatcagttaataaattaggatatcaagatagcttctatcatgtatctactggtgggggagctactcttaaatatatggaagatggccttttagtgggtgttgaagccattgatgatgttaacgaagagtaa

SEQ ID NO: 2638 - DNA, 1140 bp, Unknown
  Description of Unknown: Firmicutes sequence
atgaaaagagatattaaaaaaaatattattttaattattacatatattgcgttaattatttttgtacttgttaattttgaaaagatattatctatattaggttatattattaatattttttcgccatttatttttggagttatagtggcttttgttcttaatgttttagttaattttattgaacgtaagttatttggtaaagtaaagaagaagacatggcttaaaattaagagacctcttagtattgctattagtgttgtattagttatttttattatagtgtttattatgaatttgttgatacctcaacttaagaattcggtttctttatttactgatagtttgcctacttataaagaagatattattaatattatgaataaatttaatttagaggagaccactattaagaaggtgtctgattatttggataattttggtagggttattactgattatattaaaggtaattcaaaagatgttattactgttactactgaggttgctacttcacttattgctattattagtaaggctgttattgctattgtttttgctatttatattattgcacagaaagaaacattaaagagacaatttaataagcttatgagtgcttatttgaaacctagaacggtaaatagaattaataaatatgcttcaatggctaatactactttttctaattttgttactggacaatgtcttgaggctttgatttttggtagtttatgttttcttggtatgttgatacttagacttccatatgctactactatagcggtgttacttgggtttactgctttgatacctgtatttggagcatttattggtactttcctaggggcatttcttattttgatgattagtcctattaaagctattatatttgttgtgtttattttagtacttcaacaaattgaaggaaatttgatttatcctaaagttgttggtaagtctgttggtcttccgggtatttgggtacttttatctgttactattggggctagtgttggtggtatacttggtatgcttatagcaactcctttatgttctcttttatatatattacttagacaggcagttaatgatagaattaatagtaataagattgtcaatagagtaaaagaaaaagtctaa

SEQ ID NO: 2639 - DNA, 1068 bp, Unknown
  Description of Unknown: Firmicutes sequence
atgaaaaaaatattagtagtatttataagcattttaattcttatgccagaagtaaaatcaagtaccactagtgcatcatcatatatactaatggatcaaaataccggtagagtattattatctaaagacaaagatagtcaaagactaatagcatcaataactaagattatgacttgtatactagccttagaaagtggtaagtcagaagatgtagtaatagtagatgataatgctacttctgcatatggttcaggtatttatatagaagtaggggaagaaataaaactaaaagatttattatatggtttaatgctaagaagtggtaacgatgctgcctctatgatagcagcttatgtatcgggaagtgtcgaagaatttgtaaaattaatgaataacaaagctaaagaactaggtatgaaaaataccatcttttatacccctagtggcctcccaacaccacatggtaatttatcatcagtctatgatatggccattcttaccagatacgccatgcaaaacaaagagtatagaaaaatagtaagtactaaaaaatataaaacagcaacaaataaaaaaacctatatatggcacaataaaaataaattattaaaatacgattatataacaggtggaaagaccggatataccgaagaatcaggaagaacactagtaagtactgctaatatagataacatgaatttaatagtagtaacaataagagatagtgatgactggaatactcatttagaattatataattatgctaaagataactatatatcatataaagtattaaataaaaataaattcaacctaataggggatacctactataaaagaaataccttttatataaaaaacgatgtctatataccactattaaaaagtgaaaaaaaatctctaataagccatataaaattagaaaaaaagaaaaaatataatagtggtgacaaagtaggagtaatagaagtatatctaaaagaaaaattactacatgaagaagatatctacatatcaaaagaaaaaaagaaaaaaagaaataaaataaaagcgtggtttaatgattaa

SEQ ID NO: 2640 - DNA, 540 bp, Unknown
  Description of Unknown: Firmicutes sequence
catattattttatttattaaatataatttaatagaaaagaggaataatatgattaataagaagaatttgtggtttttaacgttatttagtttagtattggtactatcaatttattatgttactatgcctagtgaaatttttgatagtaaattagagaatgaaaaggttgataagagtactgttaatgtagaagagtcatcagtgatttctgctttgaaggtagaagatgagaatgaagttaaggaaaagattaatggtttaaaagaaaaactaactaatagtgaagttagtactaaagaaaaaaatgaagtatttgaagaattaaagcttattaataaaaattcttcaaaagaagaaactttagaatctaagattaaagatagttgttcttgtgaaaattttgttaaaatagatggagataatgttagagttgtacttgattctgatgatagtaatgctactactgctaataatataatgagactagtacaaaaggaatttgatgataagatgtatatatcagtaaaatttaataaatag

SEQ ID NO: 2641 - DNA, 1260 bp, Unknown
  Description of Unknown: Firmicutes sequence
atgaaaaagccaaccttaacagaacaattattgttaatatgtattctaatagtttttatagtaattatatctctgggtgtaattcttcctagaacactacttcctgtctatgaagaaaatttatataatcatttgaatgaatcgctaaatattattgatacacttactaaaagaaaaatcaatagtgaaattgcttatatttatatagatagtgataataatacatttgtatctagcaacatagaagatgttataaaaagtgatgatgttgatgatataatgaaacttataacaaatagtaaaggtaagtttacttataaaaataaaatatattattacactttaaatagtggtagtagcattactaaaatagctattactggtgattcatatattaattttatgaaagcccaaatacttaaaattattcttttggttgtaggaattacctttatcattatttctcttgttatactaatatggtcaaatcacttagttaatagaattaaaaaattaaaagataaaattgataatataaataatgatgattataatcataatatgatatatgattatgatgatgaattatataccttagaggtagctatagagaatatgcgggtatatttgaaagaacaagaagaatataaaaaccaaatgtaccaaaatatatctcatgattttaaaactcctatcactgttatgaaatcctatattgaagcttctgaagatggtattgaaagtaaagaaaaaactttagaggtttgtaaagaacaacttaacaaattagaggtcaaagtgcactccttgctttaccttaacaaattaaattattttcagaaacaaaaagatcaaatcaatgaaaaatgtgatgttagtaaagttgtttttgcagccgtagataaatttaagccttctagaaatgatgttgaatttgttttagatattgataaaaagaataccatttttagaggaagcaatgagatgtgggaagctattattgataatattcttaataacttcatgcgttatgcaaagaaaaaaataaaaattacagttaagaataataaaataattttatataatgatggcccaaatattgataaagaagttttaaccaatattttcactccctacgaaaaaggtgttaaaggtgtctttggtcttgggttatcaatagttaaaaaaacacttgcttttcttgattatgatattaatattgtaaacgaaaagaatggtgtcaaatttataatcagttaa

SEQ ID NO: 2642 - DNA, 1188 bp, Unknown
  Description of Unknown: Firmicutes sequence
atggaagatgaaaatagaataaattggttaggcctatttattaaaatagtaatcatatttatattcgccttaatcatcgtatggttagtagtaaaaataattggtagaaataaattatctgatacatttaaaaataatattaatagtatggagtctgtagcggtagaatacttcaaaggagaagatttaccactaagtaaaggacaaagtaaaaaaataacattacaagagatgatagataaaaatctaatattatcaataaataaggatggttctagtacttgcgataccaaaaatagttattcaaaaataacaagacaaaaagacaagtataaattagaaacaacactaaagtgtggtaaagaaaaagatacaattacaagagacttttctctaaaagattgtaagaattgtaatcaaaatacttccaataatagtagtaaagatacaaatagcaataaaaataatgataatactaattcacaatccgatactaaagtagatgaatcaaaagccacttctgataataaggcaaaaactacatattatgaatatgtaaaagaaacaactacatattcaaactgggcaagaggaaatgttacaggaaataatatagaaaataaatatgaatattatggaatagctaaagatacatattatacattaggatatgttaaagaaagtgaaataggtaaaacaattaattatacagttaaattagataaagtaccaaataataaatactattttacaacaatagaagattcaaaatactatactgcagcagatgaaagtaaatataccactgctaacaatgtatcattagttaaaggaaaaaatgataataacaataatatttcaaaatattctttaggagagtcaaactttacatataaattagcaccatattatagaaaaggctcatattatgtagatataaccatagtggtaaataatacaactggcgtttcatcatataaagatagtaaattaaatacaaatatttattatttaccaattaaattagatataaaattcgcttcaaatgaaataacaactaacaaaccaagtggtgattatgaaacaataacatactatagatatgttggaaaaaataaagaaacaaaatggtctacagaatcatcactagaaggatatacaaaaactggaaatactaaatcagaataa

SEQ ID NO: 2643 - DNA, 867 bp, Unknown
  Description of Unknown: Firmicutes sequence
atgagtaatgttaatggttatattttaaataaaattaagaataaaaatacttataaaaatttttgtttttttatgattggtctttttattaatactttatctattaatttgttttatattcctaataatgttgtttctactggaagtactggacttgctattttgattaataattttattgatattcctattcctttaattgtatttgttatttcttcaattcttttgttaattggatttatggtttttggaatggaatatggtgctaagacgatacttgggacaatattgtttcctttgtttttggaaggaactagtattattaataattttgtttcttttgataacacttctttgtttcttttaatacttattggttctgttataaatggttttggatttggacttgttaaaaaatctggttatagtatgggtggtttctttgttttatatgatcttatgaaacgtagttttaaaatatctataggtaaagctagtttgatatgtaatagtcttattattatatttggtgtatttatatttggacttgataaatgtatttatgctcttattgctatatatatttctacttatgttggtgatagagttatgcttggggtgtctagaaataaagctttttatattattactaataagccttatcttattaaggattatattattaataatcttaatcatacggtaactattgttgccgctaaagggggatattctgataaaagaaaaaggatacttttatgtgttattcctactactgaatatactaggcttaaggagattataaaagaacttgataagaatgctttctttttgattacggatagttattcggtgtctaaacaatag

SEQ ID NO: 2644 - DNA, 1272 bp, Unknown
  Description of Unknown: Firmicutes sequence
atggaaaaaataaaattaaaagacataaatgaagacatttactatgaaaaattaaataatggtttagaagtatatctatataataaagacaacgttcatacaaattatgtaacatttacaacaaaatatggatcaatatacaatgagttcgttcccattggtgaaaacaaaatgacatcatttcctaaaggaattgctcatttcttagaacacaaagtttttgttcaaaaagatgatccacagccaatggaattctttgctaaatcaggttcaatttgtaatgcatatacaactttcagaaatacaacttatcttttttatgctacagaaaatctagaagagaatataaattatctcctagattatgttcaaaatatttacttaacaccagaatcagtagaaagtgaaaaaggtataatagcagaagaaatacatatgtatgaagatcgaccaaacgaagtattaattgaaaaaacaagattgaattcattaaataacaatccttaccgcgatagcattataggtacagttaaagatattgaaagcataacaaaagaggatctagaaacatgttatcacacattctatcatccatctaatatgtttatagtggtatccggtaatttcaatgtagaaaaaataatggagacaataagagaaaatcaaagaaataaagaattcaaagaattagataaaatcaagataaaagaattcgaagaaaaagacaaagtatataaagaaaaagaaataataaaaagctcaacaaacataccaaaagctgcttataccataaagataccactaaaaaatatcaaacttacaagaagaaaactccatctatatctatatatattattcacaacactatttgatgaaacaagtgactttgatcaaaaattaaaagaagaaaatattataaccagcacaacatatgtaagtttattaaattgtaatacacatatattaatatctctaataaatgaaacaccaaagtatgaagaatttttatcaaaattaaaagaaaaattagagacattagaagtaaaagaagctgactttaaccgtaagaaaaaagtattgataagtaatgaaatattagccttcgaatcagtagaagcagtaaatgatataattatcgataatattatatatgataacaaattagaagataatccaattgaaataataaaatcattaacatataaagagttaaaagaattaattaaagaacttgatatcaaaaataccaacacagtaatagtaaagaaataa

SEQ ID NO: 2645 - DNA, 1554 bp, Unknown
  Description of Unknown: Firmicutes sequence
atgaataatactgtgttctccatttttctattcattcttgggttaattataggatttgtagttgtttttattgttaattttttaaagaagaaaagtgataataagaaagctgattctataattgagaccgctaaaaaagatgctgataaaattaaaagggattctttatttgagactaaagaggaaatacataaacttaaaattgatgctgataaagaaattaaagaaaagaagagtgaaattaaagaacaggaagatagattacttcaaagagaaaacaatattgatcgtagggatttggctcttcaaaatagggagtcttctcttgacgagagagaaaataatttattagttaaacagcaaaaaattcaagaatctaaagaagaagtggaagatattaaaagacgtgagcttgaagaactagaaaaaataagtaaatatactaaggaacaggctagagatgctgttatgaaaatggttgaggataaaatgtccaaggagatagcaacatatattaaagaggcagaagcagaggctaaacttaatgttgatgaaaagtctaaagagttattagttggtgctatgcaaaaatatgctgctgatattacttctgagcagactgtttcggttattaatttacctaatgatgaaatgaagggtagacttattggtagagagggtagaaatattagaactattgagtctgttacgggagttgatttgattattgatgatactcctgaggctattgttatatctagttttgatcctttgagaagagaaattgctagacttgtacttgaaagtttgattaaggatggtagaattcatcctgctagaattgaagagttatatgctaagacttgtagtgatatgaagcaaactattagagaatatggtaaaaatgctttgtacgaacttgctttatctaaaatggatcctgaacttgttgagattgttggtagacttcattttagaagtagttatggtcaaaatgctttaaatcattctatggaggttgctaatcttgctgggcttcttgcttctgaacttggtgaaaatgttaatttagctaagagagcaggacttcttcatgatattggtaaagctattgactttgagatggaaggttcacatgttaaaattggtgttgatttagctaagaaatatggagaggatccaattgttattaatgctattgcatctcatcatggtgatacagctcctacaagtgttattgcatcgattgtggctatagctgatgctatttcggcttcgagacctggagctagaaatgattcttctgaaaattatattcaaagattagaacaacttgaggatattggcaataagattgatggtgtagaaaaggcttatgctgtgcaggctggtcgtgaacttagggttatggttaagcctgaagaagttgatgatttgactgctcatcaaattgctagagaaataaaagagaaaatagaaaatgaacttaaatatcctggtaccattaaggttactgttattagagagactagagcacaagaagaggctaaatag

SEQ ID NO: 2646 - DNA, 489 bp, Unknown
  Description of Unknown: Firmicutes sequence
atggcaactaaaaaggatgttaaatgggataaacttaatgactatattacttatcgcattattgatagtactctttacttaattgaaaaagatgattatatcaatgatgatagttggaaacttatttgtaaaaagattaagttgttaattgaggacaataatatttcatatattaatatatcttctaaaaatatagataaaaatagaaagatttatcaggaacttggatttacaatatcttattatgatgttaataaacttaatatgatatatgatggtattaaggataaaaagttatatagaacatatggtataataactaagaatgattttttgaatagtttaaaagatgataataaaatatcttctaaaaatgaaacgattgtgtattctaattctggttttgttagtaatgtattacttttatttggtggtattttattactttgctatttttgcgtacaaggggctatttatttggttaaatag

SEQ ID NO: 2647 - DNA, 1695 bp, Unknown
  Description of Unknown: Firmicutes sequence
gtggaggttgattttatttatatgagttatttagctttatatcgtaagtatagacctgttgattttgatgatgtatatggtcaggaagaagttgtaacagttattaaaaatgctattgctaatggtaaagtttctcatgcttatctttttagtggtcctaggggaactggtaaaactactgtagctaaaattattgctagacttgttaattgtgagcatttagttgattctaagccttgtggtaaatgctataattgtttaaattttaataatagtaatgatattgttgaaatagatgctgcttcaaataatggtgttgatgaaattagagaacttagagataaaattaatttggttcctagtaatgctaaatataaggtttatattattgatgaggttcatatgcttactaaccaagcgtttaatgctttattgaaaactttagaagagcctcctagtcacgttatttttatattagcaactactgaaccttctaaaataccacttactatttcatctaggtgtcaaaaatttagattttctaagattagtgataataaaattgttgatagacttaaagatatagtaaaattagaaaatattaatattgataatgatgctttgtttgaaatagcaagagtttctgatggtggtatgagagattctattaatatgttagatcaacttatttcttatagtaattctaaaattactttgagtgatgtttatgcggttaatggttcggtttcttatgatgaattatttacattgattaatgatatatataataatgataaggttgatattatcaattttgttgataaattagataatgagggaaaggagattattaaatttcttcaagaattgttgatttttttaaaagatgttattttatataaaaatgcaaagatattatctaacattgaaataaaaaatgattatatcattaaaacttcagaattgtatagtgataatttattatatgacttgattgaaaatttaaatgatgttcaaaatgtaataaaatcttctacacatggtagtattatatttatgacttttattcttaaattttcagacgcaatatataacaatggcgataatagcgacaataatactataaaaattgatgaaaatgtagaaaaaaataaaaatagtgctggtgaaaataacaaaaaagaaaaaaatatttcccgggaaataaaaaaagtgggaaatattcaaaagatgtctgatgatgaaataaatgtgagagtaaataatgcacttgctacagcttcaaagggtgttttaaataattttaaaaataattggtctaagatagatgattatttaactgatgaaaaattttcagttgtttctggattattaaaggactttgttcctgttgttgcttctgaaaaatatgttatcgttgctagtgatttgatttcaatggtggatagaattaatgatgatattattgatgttgaaatgttttttagaaaattatttgattttaacatttttgttgttgcaattactactgatcgttggaaagatgaaaaaaataaatatgttagtaatattaaaaatggtatcaaatattatgttaaagaattgaataaaagtaatgttgatgagacaaaaaataataatcctgttgatgaattgattgatttattaggggatagtgtaatagaatataaatag

SEQ ID NO: 2648 - DNA, 897 bp, Unknown
  Description of Unknown: Firmicutes sequence
atgaaaagcggattcgtaagttttataggaagaccaaacgttggaaaaagtacattattaaatagtatattaggtaaaaaagtggctatcacttcagaaaaaccacagacaacaagaaacatgattcaaggtatatataatgatgaagatactcaaattgtttttgtagacacacctggtattcataaaccacagaataaattaggaaaagtattaaacaaacaagcttattttacaatcaatgatgtggatatagtagtaatggtagtggatattacagaaaaaataggtaagggagacaacttcgttatagatattttaaagaacttagatgaagataaaccagtattcttagtaataaataagatagataaattaccacgagaagagatattaaaaaagatagatgaatatcaaaaattatttaactttacagaaataattcctgtatctgctagaaaaaaagacaacgtagatagactaattgaagtattaaaaaaatatttaccagataatataaagtactttgatgatactactgttactagtagttcaccatcatttatcatatcagaattcataagagaaaaagtattagacctaactgaagaagaaataccacattcagtaacttgtatagtagaagaactatcagaagataacaaaatgatgaccatcggtgccacaattatcgttgatagagaaaatctgaaaaaaataataataggaaaaaatggtagtaaaataaaagaaataggtactagagccagaaaagacatagaagcctatttcaataaaaaagtatatttagatttatttgttaaagtagtaccaaagtggcgagataaagaaaaatttctaaatatgataggatacaaagattttttgaataaataa

SEQ ID NO: 2649 - DNA, 1368 bp, Unknown
  Description of Unknown: Firmicutes sequence
atgaaattaaataaagaaatatttagagaatacgatataagaggaatatgggaaaaagatattgatgaagaagtatcatatcatataggaagagcctttgctactaaattactaagttatggaaaagatacaatgattgtaggatacgataatagaataagttctaaaacaattgaagaaaacttagtaaaaggacttactgatagtggtgttaatgtcgtaagattaggactagttaccactcctatgtattattacgcatgggacaaactaaatataaaatgtggtatcatggtaacagcaagtcataatccaaaagaatataatggctttaaaatgagttataatggtatacataactgttttggtaaagaagtattagatctatactatgtaataataaatggaatatatgccgaaggaaaaggtaatatatcaaactataatattaaagaagactatataaaaatgataaataatcacattactttaggagaaaataaaataaaagtagtatatgattgtggtaatggaaccactagtataatagcaaaagatatattcatatcaaataaaaatatcgaatatataccactatatgatacttctgatggaaatttccctaaccatataccagatcctgctgttgaagaaaatcttaaagatttaaagaaaaaagtattagaagtacatgcagactgtggtatagcttttgatggtgatggtgatagagtaggagtagtatccgaaaaaggaaagtacattccaatagataaatatatggtaataatatggcgtaacatctataataaagtaaaaaataagaaaggcttctacgacgtaaaatgttctaacgtaataaaagatgaactaataaaattaggcattgaaccaatagaaacaagaaccggaaactcatataccaagaaaatatcttatgaaaacgattacccatttggaggagaatattcaggacacttatactttagagataaattcattggtaatgatgatggaatatatggtggattaagattagtagaaatactctcaaacaagaaaacaaccatctcagaagagttaaaagacatatcagtatattattcctctccagaagtaaaactaaccgtagaggactcaaaaaaggccaatataatagatagagtagaggagtatgtaaaaaataaaggatatacatatcatacaatagatggagtcaaagtaatctacccagatggctttgccctaataagaaaatcaaataccggtccaaacataataaccagatatgaatccaaagataaagaaaaactaaaacaaatagaagaagaatttacttccctattaaataaactaaaagaagagtag

SEQ ID NO: 2650 - DNA, 564 bp, Unknown
  Description of Unknown: Firmicutes sequence
atggatacaggcgcaatagttattattatagtagtgggagttatcttgcttttagtattctatggcataggagtatataacaaactagtaaatgctagaaataaagtaaatgatcaattttcccaaatagatgtccaactaaaaagaagagtagatttaataccgaatttagttgaaacagtaaaagggtatgcaaaacacgaagaaaaaacattaacagaagtaatcgaagctagaaacaaaatggctactgctagtggaattaatgaagaattagaagcttctaatcaagttactgccgctttaaataaattatttgctttatctgaagcatatcctgatttaaaagctaatgaaaactttatatcattacaagcagacttaaaagaaactgaagataaagtaagttatgcaagacaattttataatgatacagtattaacttataataacttaagagaacaattcccatctaacataattgctaatatgtttaagttcggaaaaattgacttccttaaaactgatgaaaaagataaagaagcaccacaagttaaattttag

SEQ ID NO: 2651 - DNA, 639 bp, Unknown
  Description of Unknown: Firmicutes bacterium sequence
atgaaaaaaattgatttattatatttgatagtagttatgttttatttgattaatgggttaattaagtggaatatgactactatttttgcttgtgtattatctttgatatttatggttattactattgttattggtaagaagttagggtttggtaatggtattaagatacttatatatgtttttattcttagtactgagatattgggagaaatatatcatttttatgttgatgtatggtggtttgatattgttatgcatacttattttgcttttgttatttcttatgctggattatatttgataagatattttaatattaagggaagtatttattttgtgatattatttattttttcttttgctatgatgactgagagtatttgggagatatttgaattttcgatggatagggttattggtacagatatgcagaaggatactgttattaggaatattaattctatgtatttatctcatgatatatatgttgataaggttatggttaatgatattgattttatggaaagatatggtggatatttggatattgggttatatgatactattggtgatatgatatgtacagtagtgggtagttttatgtttattgttataatgaaaaaaagactaaattgttag

SEQ ID NO: 2652 - DNA, 933 bp, Unknown
  Description of Unknown: Firmicutes bacterium sequence
atgaagaaatgcttagttgtttataatcctaattctggtaagtataataaagaagttactttaccaaagattgaaaaaatacttaatgaatatgattattctgttataatagaaaagactaaatataagggagatgccactagtattgtagctaatattgataagtgtgatcttgttgtttctattggtggagatggtacttttaatgaggttatgacgggtaattttatgagaaaagatagaattgttttatgtcatttgccttcggggactacgaatgatgttggtgctatgtggggatatagtaaaaatatgcttaataatttaaaactagccttaaatggaaaagttaaaagaatagatatttgtactattaatgataaaccttttgtttattctgctggttttggtaaatttatgaatattccttatgagactcctagagagttaaaaaaaagaataggacatcttgcatatattagagaaggggctagagatttttttagaaaagttaaactatatgatattacttatgaagtagataatgaaaaatatagaggattattctcttttgctcttattactaatgctaatagagtagcgggtattaataatttttataaagatattaaacttgatgataataaatttgaagtattactttgtaatattactaaacttaaagatattgttaagactttatatttctttgctttatatgatgctagtaaaataccaggattttatttttatcaaactgataatattaaaataaaatttaatagtcctttaaagaaacctttatgtattgatggtgaatcttttgatgatatgagtggtagttataatattaagatagatcataatgtatatgtacttatgcctaagaaaaatattaatagtttatttgtagaaaagaaaaagaaactatag

SEQ ID NO: 2653 - DNA, 843 bp, Unknown
  Description of Unknown: Firmicutes bacterium sequence
aacatgatattattagatggtaaagaagtaaaattaaaagtacttgaagaattaaaagaaaaattaacaaaattagatagaagcctaggactagtagtaatccaagtaggaaatgatcctgcgagtaatgtatatgtaagacaaaaaaataaaatggctgaaaatctaggttataatttcaatcatataaaattagatagtaatattaccgaagaagaattacttagtattataaatgaattaaataataatgatttagtagacggtatcctagtacaaatgcctattcctaagagtcttgatactaaaagaatacaaaatgctattgtgccagataaagacgttgacggcttaacagatataaatatgggcaggctagtacataatagagaatctcttgttccatgtactccaataggaataatagatttacttgactattataatatccctattgaaggcaagaatgttgtcataataggaagaagtgatttagtaggtaaaccaatggctactttaatgactaatagaaatgctaccgttacactatgtcattcaaaaacaagtaatttagaattttatactaaatctgcagatatcttagtggctgctatcggtatacctaaatatataaaagagaatatggttaaagaaggagcagttattatagatgttggtataaatagaatggaagataactcactatgtggcgatgtagactttgataatgtcaaagataaagtaagttatattacaccagtacctggtggcgtaggccaaatgaccgtagcggaactagcagtcaatacttataaggctcatatgcttagaaaaagcaaataa

SEQ ID NO: 2654 - DNA, 819 bp, Unknown
  Description of Unknown: Firmicutes bacterium sequence
gtgattattataatactttatttttttatatttgtcaattatattgctttttattttaaaaagtgctattattttggtggtggttttatggataaaaagaagaatattattattttggttgttacttctattatttttattttgttattaattttgtttattgttagtattaataaaggaaaagaaactattaatgaacttaagcctaataatgatgctaatattaaatctgctagtaaagctactgtcaataatgaagtaagtaataagtctaatgataaagatgaagatgagactataactagacaagataataatgatagtagtgtagatataaaaaatgaaaatgatgttattcagtattttgagaataattataatgatattaatagtaataaggttagtattaaagataaagctaaagaatattttattgatattgttgattttattttttatgataaagaaataaagggatatacttttagtgaacttagtgataatactaaaataaaagttattgctttggctcttaagatagatagtaaaatagaagaatatattcctggatataagaagagtatatctagtaacggaaataagatatatactgatgttaaagatagattagttagtagttatttggatttatctgttaagatttgttctaataatgaagaaggctgtaataaagcaaaagatatatttagtgatataaaagataattgtaagattggttggagttttataaagaaattggctagtgatggtggtaataaattaaaagattggtatgaaatttatagtggaaagagataa

SEQ ID NO: 2655 - DNA, 540 bp, Unknown
  Description of Unknown: Firmicutes bacterium sequence
gaggaaaaaatgaaaataacaaaagtagtagtaggattattagaagaaaattgttatgtcttagaaaaagataaacaagtcatagtagtagatccaggtgatgaatacgaaagaataaagaaagtaataggtcgtaaaaaagtagcaggagtcttaataacccataatcattttgatcatgttggagctttagaagaatttgacccaaatctagtatacaaatatgataatttagaagaaggagaacatactataggaccatttaattttgaagtaatatatactcctggtcatactaaagactcagtaagttattatttcaaagaagataatattttatttgatggtgattttgtcttctgtttaggtattggtagatgtgatttagatgatggtgactataaagaaatgatgcgtagtatcgaaaaaataaagaaatatcctaaagatatgataatatgtccaggacatggtaatcatacaacattagagtatgagatggaaagaagcttatatttcaaaagaggaaataatgaataa

SEQ ID NO: 2656 - DNA, 825 bp, Unknown
  Description of Unknown: Firmicutes bacterium sequence
atgaaagataaagtaatgagtgaaaaggctgctaaggtattggtagtagtaagtgcaatatttcttttacttgttggttttggcttgtataaattatttgaatatcaaggtattaataaagatactactagcagaaagatagttaattatgatataaaagattatgtggaaacagtaccggttgtgtttaatggttatagcaatgtatatagtaagattaatgtatctagagttaatttaaaagatttagataataatgttattaaaagctttatggatgaggaagataaattaattgaatatattactacttattataatgaaataaataatgaagtagaaaattatatatctagtaatgaagtttctagttcaataaagatgcaaattaatggggctattttatcaatatattatgaacttgattttaatttagataaaaatatatatagtaataatattaagaaatatgttattactactaatattgatttagctactggaagaattcttagtaataatgatttattaaaaaaatataattatactagaaaatatatagtagaaaaaatatttgatgaggatttaattattggtaatggtcaaattgttattgataagaatactaatatttctcttactaaagaagatattgaaagaaataaggaagaatatattaatgaattgattactgagtttgataattttattaatatgtatatagataataaaactttggtaattgtttataataaaagtgaattaagaaatatgttttttgataatgattttgattcggagttaattgttagatatttgaaataa

SEQ ID NO: 2657 - DNA, 312 bp, Unknown
  Description of Unknown: Firmicutes bacterium sequence
gtcagtcagctgttgatgaagaaaatgctgaagaagtggaagcatctgagaaataaaatgaaaaaagttccattacgtagatgtgttgtaactaaagaacaactacctaaaagtgaattacttcgtatagtaagagataaagaaggacatatttttcctgatttaaccggtaaagcaaatggccgtggtgcttatattaagaaagatataaacaccttaaacttagctaaagataaaaaaatattagaacgtgcattagaagtaaagatagatgatactgtttatgaagagatagaaaaaataataaaatag

SEQ ID NO: 2658 - DNA, 555 bp, Unknown
  Description of Unknown: Firmicutes bacterium sequence
gtgaaaataaagataggactttctaatagacatgttcatttaactaatgaagatgtagaaatattatttggtaaaggatataaattaactccaagaaattatttatatcaaccaggacaattcgctactgaagaaacagtaactctaaaaacaaataaaaatattaaggaacatgttagaatagtaggaccaactagaagttatacccaagtagaagtactagaggaagataaagaatattttgggataaatcctcctgtaagaaattccaaagacttagaaaattctgaaacaatgactataataggtccaaaaggagaaataacaaaagaaaatatatgtataattgctaatagacatatccatattaatactagagataaaggaaaattaaaagaagacgatattgtcacagtagaagtaaactctaccatcttagataatgtccatataaaaattgatgattcattcaagacagaattacatatcaataaagatgatgctataaaacataatataacaaatgaaagtgtggctatattaaaggaggattaa

SEQ ID NO: 2659 - DNA, 576 bp, Unknown
  Description of Unknown: Firmicutes bacterium sequence
atattagtatattggagtgatgttatgaaaaaaggtaaatttgttattatttctggtccttcaggagtaggaaaagatactatttgtaatgagttaattaaaaaaggagtgggcagatattctgtatctatgactactagaaggaaaagatctaacgaaatagaaggtattagttatttctttgtaagtaaagaagaatttgaaagacatattgaagaaaattattttctagaatatgctatgtataatggtaattattatggtactcctaatgaatttattaaagagactacgaataatggggataatgttattgcagtactagaaatgaatggggctattaacgctaagaagatttttagtaatgctattactatatttattatgcctccttcttttgatgaattagaaagaagacttaggggtagaaaatctgaagatgataatattattagtgagagacttaatattgctaaagaagaaattaaatgtaaggataaatatgattatatagttatcaacaatactgttgatgaggctgttttagaaattgaaaatattattaataattgttag

SEQ ID NO: 2660 - DNA, 1434 bp, Unknown
  Description of Unknown: Firmicutes bacterium sequence
atgaataataaacaaaataataaaataacaagtagagatgtagattttgctaagtggtatactgatatagtaagtgctgctcatctagcagcttattctaatactaaaggttgtacagtatttgaaccaaatggttatgctatatgggaacaaatgcagaaaatattagatgaaaaatttaaagaaacaggacatgttaatgtctatatgccattattaataccagaaaatttacttaaaaaagaaggagagttagttgaaggctttgctccagaagtagcatgggttactagaggtggaagtaaagaattagaagaacgtttatgtattagaccaacttcagagacattattttcagattactatagaacagtagtaagttcctatcgtgatttaccaaaattatataatcagtggtgtagtgtattaagatgggaaaaagaaacaagaccattcttaagaagtcgtgaattcttatggcaagaaggacatactattcatgaaacaagtaaagaagcagaagcagagacattaaatatgttaaatatatataataatttctttcatgattatttagctatacctagtattgtaggaagaaaaacagaaaaagaaaaatttgctggagcagaatatacttatactgtagaatcacttatgtataacggtatcgcactgcagtctgcgactagccattactttggacaaaagttttctaaagcttatgatatcaaattcactagtagagaaaataaactagaatatccatatcaaacttcatggggagctactactagaatgataggagcccttataatggtacattctgatgattatggtttagtattaccacctaagatagctcctaaaaaagtagttattattccaataggaaatgacttagaagtagttagtttagctaatgattatcttgataaattaaagaaagaaggaattgaagcctatattgataatagtgataagagtccaggatttaaatttgctgaagctgaagtaaatggtattcctgttagaatagaaataggtaagagagatttagagaataatatgattactttagtaagaagagatactagagagaaaagagaggtatttactaataccgatattattcatgatgttaagttgttacttgaagatattcaaagagatatgtatgatagagccttaagaagaagagaagaaatgacttatacatgtaccgatatagaagaatttaaagatataataaataaccgcccaggctttattaaagctatgtggtgtggaaacgctgagtgcgaagccaagattaaagagattagaggatgcaaatctagatgtattccatttaatgaagaaaaagtagatgataaatgtattgtctgtggtaaacctgctaaagatgtagttatttggggtattcagtattaa

SEQ ID NO: 2661 - DNA, 1026 bp, Unknown
  Description of Unknown: Firmicutes bacterium sequence
ggtctctttgacttagataataagattaaaagagaaaaagaaattaatgaacttatgttacaacctagtttttgggataatagagagactgctgataaactggttggagaacttaagtatattaaaaatattattactaatgttaatgtattatctaatagtgttaatagtgctttagaaatgattgatgatagtgatgatgatgttagacttttacttgaagaagaaattaatgaacttaaggttaagattgataagttagagattgaaacttatttaaatggtaagtatgataagaatgctgcgattatggaaatacatgctggagcaggtggcacagaatcttgtgactgggtcagtatgttatatagaatgtatagtaggtatgctgaaaagaatggatatagtattactttacttgataggcaagatggtgaagaggcaggtattaaatctattatgtttcaagttgatggtacctttgcttatggctatttaaagggagaaaaaggtgtacatagacttgttagaattagtccttttgatgccaataagagaagacatacttcatttgctgcggttgatgttataccagaaattgataatgatattgaagttaatgttaatgatagtgatattagagtagatatatatagaagtagtggtccaggaggacaaggagttaatactacggatagtgctgttagaattacacatattcctactggtattgtggttacttgtcaaaatgaaagaagtcaaattagaaataaagaaaaggctatggaagtacttaagagtaaactttatactattcttttagaagagaaaaagagtgaagtaagtgatattagaggagtgcaagtaagtaatggttttggcagtgctaaaagaagttatgttatgcaaccttataggttaattaaagataatgatagtgggtatgagtctagtgatgttgatggtattttagatggaaatattactgatatgttagattataatttaaaaaataaaaaggagtaa

SEQ ID NO: 2662 - DNA, 750 bp, Unknown
  Description of Unknown: Firmicutes bacterium sequence
aggagaattgataaaatgaatataaaattatttaagaaagctattcttttaatacatggttttgctggtggtagttatgattataatagtctaaataatgatttagaattatataatagttttgatgtatttacttttactttaccaggacatgaaagaatgattattgataaggtaactagaaaagattggattaaaaaggctgaagatgaattagaaaaaataataaatgctggttatagtgaagtatatataattggtcatagtatgggtggtgttatttcttcatatttagcaagtaaatataaacaagttaaaaaactagtactagctgctcctgcctttcattacttagcttttaaaggagataaagttgatgttttagaaagtattaaaaagcttcctaatttatttaagaattataatcctgaagaagtattatctaggttatttaaagtacctgctcctacgattagggaatttatgaagttagttgaagaacatactggagacgttaaaaatattacttgccctactttaatattacatggtgataaagatgatattgtaccatatgattctgtattatatgtttatgataatattaaatctaagagtgttactttaattgaattaaagactttaactcatgatttatttatgaatgatagatatgaagaagtaaagggtttaattattaaattctttaaaacgatacctattgataagaaaatacaaaaaaagatataa

SEQ ID NO: 2663 - DNA, 951 bp, Unknown
  Description of Unknown: Firmicutes bacterium sequence
gtggaagatatgaataaaaagaataaaaacggaagattaattgtaattatgggagctattgctattatcatagtaacagtatgtgcttttaacaaaaatacccttagatataaatattatgaatattcaattgaaaaaaaatactcttcttccactactaacgagtattatgtcgatgataactttaactatgtagataattataccggtatgggcataaataatcataaagaattaattaattttatatactacaccttaaatagtggcattcatcataccgaaagatatatcactaaagattacacaaactatttaaatgatattaatatgttaacaataaataaaggtgaaggttttaaagaaacaatatcattactaaataacttcgttcatccatacaacagttcaaataatatcaaattaaattatggtggtgaatataaaataggaataaccataaacaaagcctatagcaatgaagaaataactaaaataaacgaagtagtagataaagtaataaaagaaaaaataaccaataatatgcctactagagaaaaaataaaagtaattcatgactatattatagataacgccgaatatgataaattaaaatatgaaaacaaaaatgataccacctacaaatctaacactgcatatggagtcctaattgaaggatacggtacatgtaatggctatgccgatgccatggctatcttcttagataaattaaatgtcataaattataaaataagtaatgaagaacacatttggaacctagtatacctagatggtaaatggtatcacttagatttaacttgggacgacccaataagtgatatcaatgtaaatagagatacttacttcttaataactactaatactttagaaaaaataaatgatggtacccataaatttgataaaagtatttatatagaagcaaaagactaa

SEQ ID NO: 2664 - DNA, 1011 bp, Unknown
  Description of Unknown: Firmicutes bacterium sequence
gagatgatagaaatgaaaatagcaataaatggttttggtagaattggtagattagtatatagattaatgaaagaagatgatttctttgatgtagtagctattaatgatttatctagtagtgaagagatggcttacttacttagatatgatactaatcatagaacttatgataaagatattacttttgatagtgaaggtattattgttgatggtaagaaaactagagtatatagtgagatggatcctagtaatcttccgtggggagaacttggtattgatttagtatttgaatgtactggtaagtttactaagaaggaagatgctaataaacatattttggcaggtgctaagaaagtacttattagtgctcctggtaagggtgatatgaagactattgtttataatgttaatgatgatatattaactagtgatgatattattgtatcagcggcttcttgtactactaattgtttagcaccaattgttaaagtacttgatgataattttggtattgaaagaggatttatgactacaattcatgcttatactaatgatcaagttactttagatgtttctcataaaaaagggattaaagaaagaagaggtagagcatgtgcaatgaatattgtgcctacttctactggggctgctattgcaattggtaaagtaattccaagtttagatggtaaacttagtggtggtgctattagggtaccagtatctgatggtagtttagttgatttatctttagaacttactgagaaagttacagtagaagaaattaatagtgcatttataaataatgctagtgagactttagttactactactgatccaattgtttcttctgatgttattggtactacttgtggcgcattagcagacttatctttaactaaagtagtagaacatgatggtaaacaaatggttaaagttatttcttggtatgataatgaaatgggttattctgctcagatggttagaactgctaagaaattacttggtttataa

SEQ ID NO: 2665 - DNA, 1284 bp, Unknown
  Description of Unknown: Firmicutes bacterium sequence
ataattaaagaaaaggagagtgcagaaatgttaccatttaaaagagcaaacatcttattaccaaaagatgtagacatgaccaaatggtcagtagtagcttgtgaccaatatacaagtgaaccagaatattggaaagaagtagagagtgtagtaggttcttcaccatctactcttaatctaatcttaccagaattatatttagaagaagaaaatgttgaagaaagaatcaaaaagataaatttaacaatggaagactatttaaaagaaaatgtcttccaagaatatccaaataccatgatttatctagaaagaaaacaaagtgatggtaaagtaagagaaggattaatgggaatggttgacttagaagactattcttatgaaaaaggttctcaaacactaataagagcaactgaaaaaaccgtaattgaaagaataccaccaagactaaaagtaagagaaaatgctcccttagaattaccacatataatgattttaatagatgatgaaaagaaaaatattatcgaaagtttaaaaaacaaagtaacagctaaagatatcgtttacgactttgacctaatggaaaatggaggtcacattaaaggttataacttatctgatgaagtaattaaagatattgaaaaaggattagaaggccttatggataaagattactttgaaaagaaatataatgttaaagataaaggaatactactatttgcaatgggagatggaaatcattcattagcaaccgctaaagcaaattatgaaaacctaaagaaaactatgagcaaagaagaatatttaaataatccagctagatatgccttagtagaaatagtaaacttacatagtgaagctttagaatttgaaccaatacatagagtaatatttaatacagatgtaaataacttaattgaagaattaaataaatattatgatattaatgaagaaggaaaaggagaatactttgaattagttactaaggattttgataagaagttatatatttctaatcctaaatctaatatagcagtaggttccattcaaatgttcttagatgaatacctaaaagatcatgaaggaaaactagattatattcatggcgatgaaacaactagaagtatgggcaaagaagcaaataatgtagccatactatttgaagcaatgcctaaagaagaattatttagaactgtaatattagatggtgccttacctagaaaaacattctctatgggacatagttatgataagagattctatttagaagcaagaaaaataaaataa

SEQ ID NO: 2666 - DNA, 891 bp, Unknown
  Description of Unknown: Firmicutes bacterium sequence
ataaatatgaagtatatagaaaagtatttagattatttaaaagtagtaaagaaatatagtaataaaacaattctttcttactatgatgatttaatagaatataacgaattcttaggtaataacttcaaaaacatattaaatatagatatcgatataacaaaagaatatctaaaatatttatatgaacgaggaataaataaaaattccatttcaagaaagttaagtagtataagaggcttctataactatttagtaaaagaagaaatacttaccagtagtccctttaatagtatacctaatcctaagaaagatttatatttacctaaatttttaaatgataaagaattaaataaaatatttagtgtatgtagtgagaatactcctagtgacgaaagagatactctaataatagaattattatatgctactggtattagagtaagtgaattagtaaatatcaaagtaaaagatatcgatagaactaataaaagtattaaagttctaggtaaaggggataaagaaagaatcgtcttatataataatcatacaagtagagccttagatatctatctaaatgatgcctatcatatctttaataaaaagaataatgaatacctaatattaaatcataatggtggaaaactatctgatagatatgttagaatgattattgataaattagtaagaaaagccaatctagatataaaaataagcccacataccattagacatacctttgcaacagatatgctagaagaaggagcagatctaatgacagtaaaagaattactaggacatgaatcactaaatacaacaagtatatatacccatataaccaatgaacaaataaagaaaacatataatatggctcacccaagagctaagaagtaa

SEQ ID NO: 2667 - DNA, 1101 bp, Unknown
  Description of Unknown: Firmicutes bacterium sequence
ttgaaattacaaaaaatttatttaaaaaattatcgtaattatgatgatattttattagaacttaataataatttaaatattataataggagataatgctcagggaaaaactaatttactagaatctatttatgtacttgctgttacgaagtcttttttatctattagtgataagaatcttattaattttaatagtagatattcaatgattaaaggaattgttgattataatggttcttatgatgaacttgaactattaattaatgagaatggtaaggttgttaagataaataaaaaagagattaaaaaattaagtgattatatttctaagatgaatgttattctttttagtagtgatagtattagaatatttaaagatagtccatcttgtagaagaaaatactttaatattcaaattagtcaaattaataagatttatttagcaaatttaaataattataatttagttttacgtcaaaaaaatgaatttttgaagattattaatattaataaagagagtgatatgaattatttagatattcttaatgataaatatattggtttatcaatagttatttataattttagaaggaaatatgtagacttagttaataaatatatagatgatatatttagttctattacaggattagaaggacttaagatgatatatacttctaatgttagtaatttagataaagatatgtttaaagataaacttaaaagtaatttatcaagagaaattcagtataagattacttttattggacctaatagagatgatttttattttgatttgaatgggaagaatttatctttatatggttcaaatgggcaaataaggagtgctgtacttgctcttaagttagcagaagttaaattatttacggatgttttatctgatactcctattttacttttggatgatatatttagtgaattagatattgataagagaaataaggtaattaaatatttagataatgatattcaaacaatagttactactacagatattgaaaatattgataaaaatgtgagaaataaagctaatgtttataaaatagaaaatggtaaaattatttcccgggaaataatttga

SEQ ID NO: 2668 - DNA, 903 bp, Unknown
  Description of Unknown: Firmicutes bacterium sequence
atgggtatatttgattattttagaaagaagcagattgataatattgttgatgctgttaagaaaaaaaatattggtaaaagatatttaatgcttcttttaggatgtttgatagtggctttttcttttaatttgttttttcttagatatgatattgtttgttttggagtaagtggtatatcaattgtattaagtgagtttggtgttaatccttcagtatttatattatgtactaatattgttttaatgattgttgcttattttgctttaggctttgataatatgaaaaatcagttagtaggagctctttcttatccaatatttgtttcacttactagtatgattactaaatatattgatttaggtaatacggaaatggttgttattgctatacttggtggagtaatggcaggtattggatatggacttatttataagagtaatttttctactggtggtactgatgttattattgagatagtctgcaagtggtttaagttatctatgggtaatgctagtcttatagttaatggtattattgttataattggtaagattgtcttctcatgggatattgttttatatgctattttagtatcttacttaatatcggtatttactgataaagtacttcttggtatttctaaatgtaaagcattttatattgttactgataaaaagaaaacaaatattgttaaagaatttcttttatcaattgatggtgttggagttacattaatggaggctgaaggaggttattctaagaatgatgaatcacttcttctagcagtagttccatcaaagagttattttattgttaaagatggtttaaaagaaatagataataagatgtttttcttagtatgtgattcttatgaagtaagtgaaaaaggtgatttttcatga

SEQ ID NO: 2669 - DNA, 1140 bp, Unknown
  Description of Unknown: Firmicutes bacterium sequence
atggaagatgaaagacaaataaattggttaagcttatttattaaaataataatcatattcatatttgctataatattaatatggttagtatcaaaaataataaatagtagtaaaccatcagagacatttaaaaataatattaataatatggaagaagtagcagtttcttattttaaagaaatagatttaccacaagaaaaaggaaaaagtactaaaataacattagaggaaatgatagaaaaaaaattaattgtttctatcaatgaaaataaaaaatcaacttgtgacgtaaaaaaaagttactccaaaataactagaaataaaaaagattataaagtagaaactactttagtatgtggcaaagaaaaagataccataacaagaaaatttagttttaaagattgcaaaaactgtaatacaagaacagaaactaaaaatacaactaaagataatacaaataaggatactaacaaagatacaaccagtactaacactagcacaaacactacaaaaacaacatattacgaatatgtaaaagaaacaacaacatatagtaaatgggcaaaaggcaataaaactggcgataatatagaaaataagtatgagtattatagtactgcaactgaagaatactacacattaggagcggtatctaaaaacagtgcatcagcttcttacactataaaattagataaagttccaaataaagattactactttactatagttaaagaggtagaattcctatcaaataatgaaaaagaattcttatctagtaataatacatcaatatctaaaggaacaaaaataaataaattaccagatagtattaaaaattactcattaactgaagacaattttacatataaattatctccatactatcgtaaaggatctttctacatagatgttacattaaatgatataaatacaaccatatcatcttataataatgtatactttgtaccattaaaagtaacagttaaatttatgtctcctaaaataacagaagaaaaaccatcaggagattatgataccataacatactatcgttatgttgaaaaaaataaagaaataaaatggtcaacagaaacatcattagaaggatatactaaaacaggaaatacaaaaacagaatag

SEQ ID NO: 2670 - DNA, 732 bp, Unknown
  Description of Unknown: Firmicutes bacterium sequence
atgaaagaagtatttatgccatcaatggatgaactatacaaaatgcaagatatgggagcagacattaaactatatctatatgctaaagcaattgaagccttatgcatagaatataataactttccaagaaaaggaagtattttaaaaaatgaattcaagtatattagagaggatgaaaagataactcaggctgtatgtatgatgtatcctagagaaatagaattctctgaagtatctaaatataatcctattctagctaaacaattaatcacaaggaaagaatctagagatatatctagagatatatatagattagataatataagtagtttttatacttgtgcttcagacaatctaacaccagaagcagtagatatcctatctaaagaattaccaaataatcccaaatatcgttttgaatataaacaaagtaaactaaatagtgtcctagatgacatatttatgggaaagattaacatagataatatgtgtctatttatgaataatgaacaaagacaacaatttataagcaaattatctaggatagaaccatattatattatgcaacttatagatagtgaaaacaagagttcactcctaagactagcagtaatagaatatataaatagatatggatttaactatataagtgaaggtaataaacaagaagatattctaacaaatcaaactacagaagtaaaaagattatttagatgtataaaaagaaaataa

SEQ ID NO: 2671 - DNA, 2007 bp, Unknown
  Description of Unknown: Firmicutes bacterium sequence
atgaaagaattagaaacaattgaaggtattggacctaaaacaaaagaattacttaataaaataaaaatatatacagtagaagatttattaaattactatccatatcgttatgatataataaaaagaagtgatttaagtaatctatctgatggagataaaataataatagatggtatagttgaaggacaacccactactatatatataaataaaagtctaaaaaaaatgatctttagaattagtaccaaaacaatgatacttaatataacattatataatagagctcatttatattcagatctaaaatcaggtaaagaaataacaattataggtaaatataataaactaaagaatacagtaatagtatcagatataagattcggtttattaccaccatctgctaaaatagaacctatttattatactacagaaggattaacagtaaaacaaataagtaaatttgaaactatagctttagaaaatgattatgatgtaatagacttagtacctagatatatagaagaaaaatataatttaatgaataaaaaatccgctattaagaatattcatgtaccagaagatatcttattactaaaaaaagcaagacaaagaattaagtatgaagaattatttatgtatgtacttaaaattaattatttaaagaataaaatcaataatgataatttagcaatagaaagaaatatagataaagataaattagataaatttattaaaagtttaccatttgaactaactttagatcaagataaagcagttaatgatataattaatgatttatctataaaaaagagaatgaatagattactacaaggagatgtaggttcaggtaaaacaataattgctttaatagcagtatatgctaactatttatctaagtatcaatcagccctaatggctcctactgagatactagcagtacaacattacgaagaagcaaagaaaatatttagtaaatataaacttaatatagcactattaacttcaagtaccagtaataaagacaaaaagactatctatgaagaattagaaaatggtaagatagatttaattattggtacacaagcactaatccaagagaatgtaaaatataaaaagttaggcctagtaataacagatgaacaacatcgttttggcgttaaccaaagagatacctttaaaggtaaaggaataagtcctgatgtcctttcaatgagtgcaacaccaataccaagaacatatgccttaacaatctatggtgacaccgatgtgtcttcaattaagagtaaacctaaaggtagaaaagaaatcattacagtatttaaaaaagaaaaagatattactgatgtactagaaatgatgaaaaaagaactagaacttaaccatcaaatatatgtagtagccccaatgattgataccgaaagtgatagtgaaaaagaaagtgtatatgatttagaagaaaaagtgaataaagcttttggtaagattagtaagataggtatcattcatggtaaattagatcctaaagataaagataaagtaatgaaagactttgaaaaaaataaaattaatatcctaatatctactactgttattgaagtaggagtcaatgttccaaatgcttcaatgatcgtaatctttaatgctaatatgtttggtttatctactttacatcaattaagaggaagagtaggtagaggagatacacaaagctattgtgtactagtagctaaagaatcagaagaaagacttagattcttagaaaacactagtgatggctttgaaattagtgaatatgatttccaaacaagaggtgaaggcgatttatttggaacaagacaaagtggagaattaggtcttaaaatggctaatattaagagagacttcaagatgctacttaaagcgaaagaagatgctgacgaatttataaatatgcttttaacatttgaaaccaatccagaatttggaccaatactagaagaacttaaaaaggttgacactctagactag

SEQ ID NO: 2672 - DNA, 963 bp, Unknown
  Description of Unknown: Firmicutes bacterium sequence
atgggattatttaataagataaaaaatgtctttttaaaagacaaagaggcagcaaaatatgaagaaggacttactaaaacaagaaaagaattttcaactgaattagctaagttatccaagaagtataagaatattgatgatgattattttgaggaattagaaaatattctaataatggcagatattggtgtaaatacagttgtaaaatttgttgataaattaaagaaaagagtaaaggaagaaaatataaaggatagtgaaactctaaaagaaataataattgatgaactattaataatgtatgtaaataatggcgttttaaaaagtaaaataaattatagtgaagaagggccaaccgtaattctctttattggtgttaatggagttggaaaaacaacaagcatcggaaaaattgccaataaattaaaaaaagaaggtaaaaaagttctattagtagcgggggatacctttagagcaggtgccatcgaacaaatagaagaatggggaaaaagaatcaatattgatgttgttagtactaaatcaaaagatccatcagcggcagtatatgatggcgttgacaaaggaataaaagaaaattatgatgtaatcctaatagatacagcaggaagacttcaaaataaagtaaacttaatgaatgaattatccaaaatgaattccgtaataaaaaaactgattcctaatgctccacatgaaacacttttagtagtagatgctacttcaggacaaaacggaatatcacaagctaaagcctttagtgaagtaacagatataacaggaatagtcttaaccaaattagatggaacagctaaaggtggtatagttcttgctattaaagaagaagtaaatataccggtaaaatttgtagggctaggagaacaagaagatgatttagaagcctttgatattgaaaagtatatttatggtttatttaaagatttataa

SEQ ID NO: 2673 - DNA, 894 bp, Unknown
  Description of Unknown: Firmicutes bacterium sequence
tttaaaataaggaggaatactatgattactgcaaatatggtaaaagagttaagagaagcaacaggagcaggaatgctagattgtaaaaaagctcttactgaaacaaatggtaatatggaagaagcaattacttggcttagagaaaaaggaatttctaaagctgctaaaaagcaaacaagaattgctgctgaaggattagctaaggctaaagtagaaggaaataaagctgttattgttgaagtaaattcagaaacagactttgttgctaaaaatccagaatttactggattagtagatttaattgctactgcaattttaagtagtaatgtaaaaacagttgaagaagtaatgaaattagaagtagaaggtaatactattgaaaatattattattgacaaaactgctactattggagaaaaattatcatttagaagatttgaactagtagaaaaagaagataatcaagtatttggcacttattcacatatgggtggaaaaattgttacattagcagttttagaaggaactgatgaagaagtagcaaaagatgttgctatgcaaatagcggctatgagaccactatatttagataaagattcagtacctactgaaagagtagaaaaagaaagagaaatcttaactgaacaagcagagaatgaaggactagatgctaataaattacctatgattgtaaatggaagattaaataaattctatgaagaagtatgtttattagatcaaggctttgtaaaagaaaacaaaatgaaagtatctaaatatgtagaaagcaaaaatatgaaagtattatctttcgtaagatacgaagttggcgaaggtatggaaaaaagagaagaaaactttgctgacgaagttgcaaaacaaatgaatgcataa

SEQ ID NO: 2674 - DNA, 1269 bp, Unknown
  Description of Unknown: Firmicutes bacterium sequence
atgaattttgaaacaattaatatggggggatataacctccatttaattaaaactaataagtttaagacgataactatagatgtagatttttataggaatattaagaaagaagaaattactgagagaaatttacttaagatggtattattagattctagtaataattataagacggaaagagatcttattattgaaagtgagaatttatatgatattaaggtatcatctagtatatcaagaattggtaattttagtaacttatcttttcaaactaaatttttgaatgagaagtatactgagaaagatatgaataaagaatctatcatcttttttcttgatttgatatttaatccttatgttaaagataatacttttgttagtattgataatcaaaaaaatagattaagacaagatattcttagtattaaggataataagattagatattctattcttaaattaatggaaaagatgaaagataaaccttattcttataatacttttggttatcttgaagatatagataatattactggtaaaagcttatatgaatattataagaaggtattaaaagaagataagattgatatttttgtattaggagattttcaatctaatgatattaaagaaatatttaaagaatactttaagatagatacttttaagaaagaagataagaaagtactagtaaaagaattagttcctagaaagagaattgttagataccgtgaatatgatacggtaaagcaatcacaattattattacttgctagtttaaatggtcttactgattatgaaagacaatatgttataaaattatataatgagttacttggaggtaattctaattcgatattatttaatactgtaagagaaaagaatagttactgctactacattaattcttcagttaaggcttatgataatattttaattattaattcaggagtagaggctaagaatattgataagagtattaagttaataaagaaatgtttaaaggatgtaagtttaggtaagttttctcttgatgacttagattcttgtaagaatactattatatctgctattaagtctaatagagataatcctattacggctattaatacatacttttctaaagtacttgtaggtagtgatagtgatgaagagagaatagagaagtttagtaaagttactaaagaagacattattaaagttagtaaaaagattagtcttcatactgttttaacactggaacctaaggaggaagagcatggagaagattag

SEQ ID NO: 2675 - DNA, 615 bp, Unknown
  Description of Unknown: Firmicutes bacterium sequence
atggttatacttttttcttatatatatttctttttggttaatactattactagaaaggagtgtgtatttatgaagaaagttttattacttattgcagtagtagcggttttatcgggatgtggaactaatgataaacttacttgtacttatgataatacagtaggtgatgttacttctaagactgaatatgttattgaatatagaaataataatattaaaaaaataaaggctacttatgattataaaagtaatcatgttgatggagtaggtactggtactgatggaactactaatgataaagatgataataaagataatgatggtatactaggtggtactgttggtagtgttttagatgatgttgttgatggtattactgatggtatcattgatatttctggtattaagacaagacacgatagtaagtttggtacttatactaatattaaaggttttactagtgatgttaatgttaatgatgatactaattataaagttatttatacttatgatttaaatactttatcagataatgatattaataatcttggtattaatagagacttaaatacttttaagactactcttactaatcgtggtttaacttgtaaatag

SEQ ID NO: 2676 - DNA, 1401 bp, Phascolarctobacterium succinatutens
atgtttatgaatagagggtgtttcttgatgactaaaaaggatgctgtaatcgtttacggcgcaggcatcagcggccgtggcgcagcgcaggtgctggcagatagaaagcagcaggtatatttgtataacgatatggactgtactttagagccgcagctgctgcagcttttagagagcgttggcggtgggctggccatcggtcaggctgcatttgaaggcctgcttgatattgcaggtgtgctggtgctttctccgggtatcgcctgcgataacgcaaatgtgctgctcgcagagcagcgcggactggaggtcatcagcgaggttgagcttggctacaggctgtatggcggtcacattgccgctatcaccggtactaacggcaaaaccactaccactactattgtgggcgagatgctcaaacgtctgccggagccttctgcagtaggtggcaatatcggcctggcactgtccaaggaggtagagagcctgcctcaggatggttggctcgctgccgagctttccagctttcagctggaaaaagtcagcagcttctgccctgacatcgcagtagtgctgaacctgactccggatcatctggagcgccatcatacgatggaggcctacggcgaggcgaagaagaacattttccgtcagcagggcgaagtgcaggttacggtgcttaattacgatgatcctattgtgcgtacctggggtgcggaaactaaaggccgcctgtgttacttcagccgtaaggaaaaactgcagcagggcatctatatgcaggatgggaattttatcatcagctgggacggcaagcaggaaactgtctgcaatatcagcgagctgcatctgttcggcggtcacaacgaagaaaacgtgctggcagccattgcctgcggctttttcgccggtgtgagcatcagcgatatggctgatgtgctgcgtaacttccgcagcattgagcaccgcattgaatacgttgctacgattgatggcgtaccgtattacaatgattccaaggctaccaacaccgattctacaattaaagcgctggaggccttcaaggatggccacatcatcctgctcgcaggcggccacgataagctgacgccgctggagccgatgatggagcttgttaaggaaaagactgatgctctgattctgctgggcgctgccaaggagcgctttaacaaggcagctgttgcctgcggcgtgcagaatatcgtgctggctgacagctttgaggacgcagtgagcaaggcgcattcgatggcacataagccacaggtagtgttgctttcgccggcctgctcatcctttgatatgtttaagaattatcccgaacgcggaaattattttaaaaagctggtacacgagctggagggaggtaacgttaagtga

SEQ ID NO: 2677 - DNA, 1314 bp, Phascolarctobacterium succinatutens
agagaaaaaagaccttatggtcagaagataaattttagaggaaaagaggaatgtgaaatgacaaatggatttgcagccttaaaggtttgtgcccacaccgtagagcagcttcagaaaatgggcattaaaaagccgatgccggtacaggagcaggctataccggcgctgtttgccggacgtgatgtaatcgcccgtgcgcagacaggcactggcaaaacactggcgttcttagtgccgctggcagaaaaaatcgatactgccaaaagctatgtgcaggctttggtaattacgcctacgcgcgagctggcgcagcagattgccaccgaaatgaaaaaaatcctgggcgaaagcgatatcaaagtgctggctgttaccggcggacgcgatttcgaaacgcaaaaatataagctggagggacgcagccatgtgctgatcggtactcccggccgtcttttggaccacatccgcaagggcaacaccgaccttggcggtgtgcgctatctggtactggacgaggttgacgaaatgctgcagcagggctttatggatgaagcgctggagctgattgctatgaccgcgccggagcatcagacgatgctttgctccgcaactctgtcggaagaagtgcgcaagctgggacgcaagctgacgaaaaactgcgcgctcattgatatcaacccggatcaggctacagttgagaaaatcaaacaggtttgcctgaaaacaaccgatgaatacaagaataaggctgtggcagcgctcattgaccgcctgaacccgtatctgatgattgttttctgcatgagcaaggagcgcactaaggagttgggcgactggctgggcatgcaggactataacgttgatgtgctgcatggcgaaatgtctcctgcaaagcgcaaaactgttatgaaggccttccgtgatgctaagattcagattctggttgccagcgacctggctgcccgcggtttggacgttgagggtgtaacccatgttgtaaactacgatattccgcatgatgtcgactggtatgttcaccgcatcggccgtacaggccgtgcaggcaatgagggcgaagcaattacgctttatactgccgacgaggttaaatggctgcgtaatatcgaaaccaagctgggtattttgatggaacgccaaaatctggagggtggtgttgtggcacgccgcgtcgctgtggctgccaaaaagaaaaagtccgcaggacctaagcgcggacgcaattccgttgttgataagcgcaaggctcccaaaaccggcagtaaccgccgtcagggtgctaaaaaaggcaaataa

SEQ ID NO: 2678 - DNA, 948 bp, Phascolarctobacterium succinatutens
ttgcatccggcaaaatttacaagcggcgaatttgcggtatggaggcaggtttttatgtttgactatctggccttgtttcaggaatatctgacggtagagctgggactggcaaaaaatacacagctggcgtatatgcgtgatttgcgcctgctgatgaaaagcctgcagctgaaggcagatgaggagctgctgcaggtttcgcgacagcagctgattgcctatcttgtgcggttgaagcaggagggccgcgctgcctcgacggtggcacgcaagctggcttcgattaaggcgttttaccgttttcttacggcagagcgttatatccgacgcaatcctgccgaggtgctggaggcggcgagcagaggactgcatttgccgaaggtgctgagcgttcaggaggtcgaaaggcttttggatgagcctaatttgggaaccttggacggttatcgcgacaagacaatgctggagcttttatatgctaccggcatgcgtgtgtctgaactggtaaatgtgccggtgaaaaatgttgatatgaagatgcagtatgtcattgttatgggcaagggctccaaggagcgtatgttgccgttaggccgtactgcgctgcattatctgaagcattatttgtctgtggtacgcccgcagcttctgcatggcaagcctgatacggctgcagagctttttgtaaccggttggggcgggccgatgacaagggagcgtttttacgaaattattgtggcatacggcaagagcgcaggcatcagcaagcgcgttacaccgcatatgctgcgtcattcctttgcgacgcatcttttaaataacggcaccgacctgcgcatagtgcaggagcttttgggacatgcagatatttccaccacgcagatatatacgcatcttgatgtggagcgtttgcgcgaggtgtacgataaaacgcacccacgggcttag

SEQ ID NO: 2679 - DNA, 690 bp, Phascolarctobacterium succinatutens
aaaaagtgtgcaacttcttattgcaatttagaaaggagaaataaattgagtaagcaaagcattattaccggtgaggttttattgctgtgtgaaagattggagatggcgcagtttatgcatgcctatctccggcatttatttaagcagggaatcagcttgcctaacatgcagattgtaaattatcagagtatcgataagttagacttgctgactaaacgccttatacagctggaaggcagagaaatagtgcgcaaagcagtattctttgccgacgcggctgatgagcgcgaacgccgaatgcagaaattttttgcagtgcgtgacaatactttctttagagaagtggagtattgcacgcactttttctttcccggcaaaaaagctactaaacgttggcaaaaaggctatcttgaggatatgctgctgcaatcgctgcggcaggaaagctccgaatgcagcgattactataatctttataatgtgagtgcggaatatctgcagactgtaaattgctgccgtgggcgtgagaacggattaatgaactacagcaggcatttattgtatacatatttcgcaggaacagaaaggtatgtgggcatgcgcttgggcgaggcggctctggcaggagcctttgatttggagcatccgtgctatgcgagtcttaaggaatgcttgcaaggcttaaactag

SEQ ID NO: 2680 - DNA, 1143 bp, Phascolarctobacterium succinatutens
atggatgaattagggtggtatcacgaagcaacgctttcgtccctgtatttttacaggaacggaagcttttttattgctcatcctcctgtaacaagtcgaaaatctaagttaggaaatgtaggaggaacaacaatgccgattaaaatcaatgaccatttatccgctatctgccaactgcaggaggaaggaatttttaccatgacagagcagcgtgcgacaacgcagcgtattcgtccgctgaaggtgtgcgtgctgaacctgatgccgctgaagaagccgacggaaattcagctgctgcgccttttgggcaattctccgctgcagatagaggttgatttctgccgtactgtgagccgtgaaactacgcataccgataattcgtatcttgaccgcgcttatctggagtttgatgatgttaaggaccgctattacgatgccttcctgatgacaggtgcgcctgtagaaaccattccctttgaggctgttgattactggaaggaaatcgaagcttatctggactgggcagaatatcactgctattctacgatgacactttgttggggcgcgcaggctgccttgtaccattattatggtgttaacaagacgattttgccagcgaaaatgtttggcatcttcccctatggcctgacagtgaagaatcatccgctgctgcgtggctttgatgacagatattttattccgcagtcacgccatactgctgttgatgatgatgcgattgatgcctgcaaggctctgcaggtgctgtcccgttcggtagaaaacggtatcaacatctgtgctaccaaagatttgcgccgcattttcgttttaggccattttgagtatgatcgctataccttggctaatgaatatttccgcgataagaaaaagaatttgccgattgatttgccggagttctacttcccagatggcgatacaacgcaggaaccggtttttaaatggcgcagttacgcgcatctgttctatatgaactggctgaacattgtttaccaggatacgccgtatgatttgcacgagctggcaccggcgagcggtaataagctggataaggctttgggcgaatataacaaaattcttttgcagctgcagcgcatgggtgcagcaattcctgccaatcaataa

SEQ ID NO: 2681 - DNA, 1140 bp, Phascolarctobacterium succinatutens
atggtgcagggaggaaagaaagtgaatttacagaatcgcaaggttaagatagcatttggcctgatgctggcggtatgcgtaattatcggctaccgtatttacagcaatattcaggctgataaggcgcgtgctgccagactgtcgcaggtacgcaatgtggcggtcgttactgctcaccccataaggcagacgattgttcccagtctgagcttttccggcagtttggacccggaatggcaggcagaggttgccgctaaggtggacggacgcttggaaaaggtttatgtccgtgaaggcgaccgtgtgagccgtgggcaggtgttggcaattttggagcaagctgataccgatgccaatctgttgagcgccaagggcagctttttggatgcacagacaagcttgcacaaggcggaaacagatttgcagcgctatgaaaagctatatgctacgggtgctgtttcgcagcaggtggtggatgattaccgctttgcgcgtgataatgctgcagctaagctggaggctgccagaggcagtctgcgggcgatggagtctaagtctgagggcacggtgctgatagcgccggctgatggcattatttctaagcgttattatcaggagggctattacgcaaaggcaggtacgcctatttttgccgttgctgatatctctatgctgaaaactacgattcatattcccgaaggacagattgccggtgtacatgtcggcaatgaagcaagtattaccctgcctgcttatcctggtaaaaagctgataggcaaaattacccgcatcgctccggttgcggatttgccggcgcatacttttgcggcagaggtgagcgtggataacagcgaaggtcttttggccggcgtctatgccaacgttacgcttacagcttcacctaaagctgatgtgctgactattccggtgcaggctattgtgatgcgtgatgaccagcagacggtgtttgttgttgatgataaaggcgttgtacagcgccgtgtgctgaatgtcggctatacgaatgataagcttgctgaaatagtgagcggactggatgaaaaggatactattgttaccgaaggacataacaagctgcgtgaaggcagcaagatagatttgaaaaaggctggtaaataa

SEQ ID NO: 2682 - DNA, 507 bp, Phascolarctobacterium succinatutens
gtgaagattctgggttcctccgttgacagcatcgaccgtgccgaggaccgtgaacgcttcgatgagctgctgacaagctgcgatatcccgcgtccgcaaggccacaccgtattcgacaccgagggtgcgctggttgctgctcacaaggttggctatccgactatggttcgtccttcctacgtattaggcggccgtgctatggaaatcgtttataacgatgacgagctgcgcaactacatgacctatgccgttaaggcttctcacgagcatccggtactggttgaccattacctgcagggtactgaggtagaggttgacgctatctgcgacggcaaggaagtattaatccccggcatcatggaacacgttgaacgtgcaggcgtacacagcggtgactccattgccgtatatccgccgcgcagcctgagcgaaagtgttatccgtaccattatcgaatacaccaacaagatggctctgggcctggaagttaagggcatgatcaacatt

SEQ ID NO: 2683 - DNA, 579 bp, Phascolarctobacterium succinatutens
atggctgctactcagcgtgacttgattgccggtgaggtttccaaggacctgacgaagcgtattatgctgccggcaaagatttcgaaggcgcatgaagagggcgtgctgcatttccatgatgccgactattttattcagcctattttcaactgctgcctgattaatatcggcgatatgctggataacggcacggttatgaacggcaaaatgattgaaagtcctaagagctttcaggttgcctgcaccgttatgacacagattattgcttctgttgcttctagccagtacggcggtcagtctgttgatatccgtcatctgggcaaatatctgcgtaagagctacgaaaagttcaaaaagggtattatggaggccgctgaaggcaacattgatgaggaaactctggagcgtctgacaaacgagcgcctgcgctacgagctgaagggcggcgtacagactattcagtatcagattaataccttgatgaccaccaatggtcaatctccgtttgttaccctgtttttgaatctgcagaaggatgatccgtatctgaaggaaaacgccatgattgtggaagaaatt

SEQ ID NO: 2684 - DNA, 855 bp, Phascolarctobacterium succinatutens
tttcaaaaagtgtgcaacttcttattgcaatttagaaataaaaaaagaacaggagggcagtatatgttgacaattcgtgaatataagcaggcaacaactctggaggaggcgtggcagctgaaccagaagcgccctaaccgcttgcttggcggtatgctgtggatgcgcctgagcaagagcaatgtgcagacagctattgatttgtcggctttaggcctggatacaatagaggaaacagaaacggaattccgcatcggtgcgatggtgagcttgcgccaactggagctgcatgaaggctttaccgcctacagtgagggagcaaataaggaggcgctgcgccatattgtaggtgtgcagttccgcaatattgctaccgtcggcggcagtgtgttcggacgcttcggattttcggatgtgctgaccttgcttttggtgatggacagctatgtggaattatacaagggcggtattgtgccggtggcagattttgtgaatatgccgtatgacagagatattctggtgcgcgttattgttaaaaagacagcagcgcattacagctataaatccgtgcgcatcagcaaaaccgactttccggtgctgacctgcgcggcagcgttgacgcaggaaggcgtgcaggctgcagtgggcgcacgtccggcgaaggctgcactggtgaaggatgcagagcagctcgcaactctgcctatgactgccgagaaggcgcaggcctttgcggaatatgctgcaggcttactgccgacggaaaccaatccgcgcggcagtgctgcgtatcgtacacacctgattaaggtgctgacagcaagatgtttaacagaactgggaggtaaggcctga

SEQ ID NO: 2685 - DNA, 1041 bp, Phascolarctobacterium succinatutens
ggcgtcagaacaaaggggagacaatttatggtaatagtatttaagccgggagcgccggaggaaaataaagcgaaaatgcgcagcaatttggaaagcaagggcttccaaattaacgaaattaatggtgtcaacatgaccattttcggtatcatcggcgatacgagcacacttgatatcaatatgctgcgtattgatgatgcggtagacaaggtaatgcgtgtgcaggagccgttcaagcgagctaaccgcatgttccatccgcaggattccgtgattaatgtcggcggtgttgaaatcggtggacgcaagattcaggttatcgcaggtccgtgctccgtagaaacgcaggagcaggttacggacattgccaagtccattaagcttggcggcgcctcaatgcttcgcggtggcgccttcaagccccgcacatcgccgtattccttccaaggcttgaaggaggttggcctggaatatttaaaaggtgcaaaaaaagaaacaggcctgccgattgtaacagaaatcatgtcaccgtatatgattgagcgttttgtagaagatgtagatttgattcaggtcggcgcccgcaacatgcagaactttgaactgctgaaggaattgggcaaaaccaataaaccgattcttttgaaacgtggtttggcagcaacaattgaggaatggctgatggcagcggaatatatcatgagcgagggcaacgagaacgttatcctttgcgaacgcggtatccgcacttttgaaacatatacgcgcaatacattggatgtaagcgcaatccccgctgtgaaaaagctcagccatctgccggtagtagttgacccgagtcatgcggcaggcctgtggtggatggtagagcctttggcaaaggctgcggttgcagtaggtgccgacggactgttgattgaagtacacaacaatccggaagcagcgctttgcgacggcgcacagtccttaagacctgaacgcttcgccagattgatgggcgagctgaagggtattgccagaattgttggcagagatatgtaa

SEQ ID NO: 2686 - DNA, 543 bp, Phascolarctobacterium succinatutens
cgagcttatcgtcaaaatcatgcaggatttggagcagaatatatgaaaaatatcgtgctgattggtatgccgggctgcggcaaaagcacatttggcaagcgcatggcgaaacgtttgcagctgccgttttatgatgctgatactgtcctcgaagagcgtgagcagcgtacaatcaaggctttctttgcggaaagcgaggatgcgttccgcgcagcggaaacgcgcacgctggcgtatctggcggaatgtgacggagctgttatcgctaccggcggaggtgccgtaaagcgtgcggaaaacatggagctgctaaagcgcggcggtgttgtggtctttatcgaccgcaaaccggaaaatatcatcggatgtattgccggtgatgcgcgtccgttgcttgctgccgataagcagaagctttatactttatataacgagcgtattgcgctgtaccgccgatatgcggattatactattgataataacggcgatttcggcagagttctgcatgagctgctgaatattgccgctaagctggagggataa

SEQ ID NO: 2687 - DNA, 1638 bp, Phascolarctobacterium succinatutens
atgtatattaacctttataaaacgtatatattcagaactgttaataatcaaggaggcgtacgcatggcaaaattcacatttcggcgccataagctggcagcagccatatgcacagctgctttactgatgccggtttccgtccaggccaaacgcctgactattctctatgtaccattagacaacagacctgtctgctccgcctatgtaaagcagacaatggaggcagcaaactgtaaaattattctgccgcctgaaaaatatattgccactaacgaaaaaaacggtaatcccgaagctatctgggactggctggagcacaaggctcccaaggccgatgccgcagttatcagcacagacagccttgtttacggcggccttgtcggctcgcgcacacacaacgtaagccaagaggagctgcaaaagcgcgttaatcatctttacaagctgaaaactaccctgccgataaagctttatgctttttcgacgattatgcgcacaccgcgtgccagcaaaggacgtgtagaaccgccatactacagcaccataggcccaagtatctttgcctacagccagctgcttgacaaacaggaccagggtaagctgtcgcctgcagaaaagctgactatgcaggcactggaacgcaacatgaaaaaagctgaattgggcgactggttggagcgacgtgaaaaaaatttgcttgttaaccaggagcttacacgcatggcccgcaacggcaaatttcattattttgccatcggcaaggatgacaatgctactctttccgctacgcacatggaaggacgcaaaatcagcctcagcacctttgatatgagcagggactgctttcagattttggacggagttgatcagctcggactgcttttaatcgcccgtgcctacaacgaggccaacggcaccaaaccttccgtctatcccctgtacagcgtaggagccggagcctccaccctgccccagtacagcgatgctcgcttgcaggacagcgtaccgcagcagattatcgctgccggtgcagtacaggcacaatctgcggacaacgctgaccttattttggcactcaatacgccgcaggacggtatcgtcaaggattccacagcagacgacaatcagcccttcgcatctgccggcaacaaaaattttgttggaatcctggggcagctgctccgttccgggcgcaatgtttccctggccgatatcagctattccaacggtgctgacaacggctttatgagcctgctggccaacagcatcaacctgcagccgttagcagcctacaatggctggaatacagctgacaacgccgtaggctatgccatcgcccaagggcttatcgcacgcgatatgagcagcgaagcacgcagcagattgctgcgccaacgccttatcgacgattggttttaccagagcaatgcccgccgcagcatttccaacgagctagaaaagcataaccgtgaggatttgaaatatgatcttgctacagaagaaaaaaacatcctgcaccagattactgccgactgccaaagcatggccaacagctattctataacaagaggcactaaattcaccctctccttcccttggaagcgtttattcgaggtagacgtagaaatcaagaaataa

SEQ ID NO: 2688 - DNA, 603 bp, Phascolarctobacterium succinatutens
atgaaagttattaaacgcgatggcacaacagtagattttgatgccgcaaaaattgtcgttgctattcaaaaagccaatgctgccgtggaaccggaatttcgtattgaggaggataaaatccaggaaattgcggatagcgtacaatctcgtaaccgcatgcgtctgcttgtagaggatattcaggatatggtagagcatagcctgatggatgccggtaagtttgaattggcaaagcagtatattatttaccgttataaacgtgctctggtgcgtaaggccaacactaccgacgattctattctgtccttaatccgcaacagcaataaggacgttatggaagaaaacagtaataaaaatgcaacgatggctgctactcagcgtgacttgattgccggtgaggtttccaaggacctgacgaagcgtattatgctgccggcaaagatttcgaatgcgcatgaagagggcgtgctgcatttccatgatgccgactattttattcagcctattttcaactgctgcctgattaatatcggcgatatgctggataacggcacggttatgaacggcaaaatgattgaaagtcctaagagctttcaggttgcc

SEQ ID NO: 2689 - DNA, 789 bp, Phascolarctobacterium succinatutens
ctgccgggcggcggactaagtctttgtcataaaaggaggtataaagtggactccaggagtgtacttgaacaggtgcgcagcggcaagctgtcggtggctgaggcggagcgctattttaatcgcaaggcgtacgagaatttaaattatgcgcgtcttgatacttcgcgtgagcagcgcacgggctttgcggaggtggtttactgcagcggtaagcctgatgcgtatttggcggatatttataagcgtcttttggcggagcagggtgaggtgttcggcacgcgggcaacgccggagcagtatgagctggtgcggcggcagctgcctgatattgtttatgatccggtggcgcggacgctgaagcgggagcgcccggataaggtgcggagcggttgcgttgttgtgtgtactgcgggtactgccgatattcccgttgcggaggaggcggcgcagacggctgaatttttcggggcgcatgtggagcgtctttacgatgttggcgtgagcgggattcaccgtcttttggataaggttgatttgctgcagcaagcaaattgtgtagtgacggctgcaggcatggagggcgcgctggcgagtgttatcggtggccttgtgcgtaatccggtgattgcggtgccgacttctgtcggatacggtgcgagctttcatgggctgagtgcgctgctgacgatgattaattcctgcgctaactgtgtttcagttgtgaatattgataatggatatggcgcggggattattgcgacgcagattaacaggttggcgtgcaagtga

SEQ ID NO: 2690 - DNA, 1020 bp, Phascolarctobacterium succinatutens
atgaacccgcaagcattagcacaagaaattattgatggcagaagactgactcgtcaggacgatttaaaggcatttctgacctgcgatttgcaggcattatgtgaaggcgcagataaaatccgcaagcattttgtcggtgagcgcgtggatttgtgctccattatcaacggacgcagcggccgctgtccggaaaactgcaaattctgtgcgcagtctgcacataaccataccgattgcgaggtttacagcttccttccggaggaggatatcgtgaagctggcacgcctgaatcaggaggaaggcgtacaccgcttttccattgtaaccgccggcaaggcactgaccggtgaagaattcgacaaggcaattcatgcgtatgaaaccatgcatcgtgatttgaagattgatttgtgcgcttccatggggttcctttcccgtgagcagctgcatcgtctgcatgaggcaggtgtcaccagctatcaccacaacatcgaaacctctaagcgcaacttccccaacatctgcaccacgcatacctatgatatgaaaatcaacacgctgaaaatggttaaggaggagggcatgtgcgcctgctccggcggtattatcggtatgggcgaaacctgggaggaccgtcttgatatggctatcagccttgctgagctgggtattgattctattccgctgaatgcgctgatgccgattccgggtacgccgctggagcatctgccgcgtctgagcgaggatgatatcctgcgtactgtggccttcttccgttacatcaatcctttggctaatatccgtctgggtgcaggtcgtgctttgctgaccaatgacggcgaaaccgccttcaaggcaggtgcctccgcaactattaccggcaatatgctgactactgtggcctgcgctacgattcgcagcgacagaaaaatgctgaaccatatgggacgtgacattaagccggaatatatgacggatgaagaagctgctgctatttatgccagagcggaacaggcataa

SEQ ID NO: 2691 - DNA, 1320 bp, Phascolarctobacterium succinatutens
atgcttacgaaaaaatatcaggctgtgagggaacgcagccgaattttggaggatgtgcttatgcaaaataaatatgctgtttatgaggaggcgctggcggaggagcttattcccgccatgggctgtaccgagcctatcgccattgcttactgtgctgctgtatgtcgcgagcaattaggagctttccctgagcagattgaaatctgggttagccgtaatattatcaaaaacgttaagagcgttgttgtaccgaataccaacaagatgaagggcattgaggttgcctgcgctgctggtgtcgttgccgctcattccgagcgtcagctggaggttctggcttatattaaccaagaggaaaaggctgaaattaaggcgttggctgaatccggcaagattaatattcacgtttccgaagaaccggatattttctatatccgcatttttctggcagcaggcggcaataatgctgaggtaactattcgtacggaccacactaatgttacctgcattaagaaaaacggcgctactgttttggaaaaaccgattgtgcctgccgaagaagaggctaagagcctgtggagaatcgaggatgttctggatgcggcccgcaatatgccgttagataatgttaagcatctgctgaaacgtcagattgatttcaatatggctatttccaaagaaggcctgaccaatgattacggcgcaagcatcggcaaaattttgctgcgtcgcgatccggacagcctgcgtatccgcgcacgtgccagcgctgctgcaggcagtgacgcgcgtatgaacggctgtgagcttccggtagtaattacctccggcagcggcaaccagggtattaccgcttctgttcctgttgttgtttatgcacatgcattggctgcaggcgaagaaaaaatgctgcgtgcagtactgctgagcgaccttgttaccatttacctgaagcagggtatcggtaagctgtccgcatactgcggtgctatcagcgcaggctgcggtgccggtgcggcaatcgctttcctgtatgattgcaccgatgaccagatcgagcatgctgtagaaaatgctctggctatcaacagcggtattatctgcgacggtgcaaaatcctcctgcgcagctaagattgctatggctgttgaaggcggtctgatgggcgttgatatgtccgttgctgaacgtaactttgccggcggtgacggcattgtccaaaatactgccgatgaaaccattgctgcagtcggcaaaattgccagccagggcatggtagaaaccgataaagaaattattgatgtaatgcttggcctgtaa

SEQ ID NO: 2692 - DNA, 1701 bp, Phascolarctobacterium succinatutens
tcaaggtcaacgctgcaatgcaagccgttggcgaataaaatgcttaagctgcagttgtccaatggacaaattatcgaagtagaggagggcagcactctgctgcctttagctcaaagattgagcgataaatatgcttctcccatcgttatgggactttataacggtgaggaatgtgacctgcagcgtccgcttactgccgacggcactgttgatttcgtggaagtcaacaattccgtaggcatgcgtgtttatgtgcgcacgctgctgtttatgctgattgcggcaaccaaaaagctttatcccgatgtacatctggaggtgcgcaactctctgggaagcgcactctactgtaaggataacagtgagcgtaagcttaccgctgaggatatccgcagcattgaagaatatatgcacaaaatggcagaacgcaaagagtctattaagctgctgcgtctgcctaaatccgaggctattgatatggcctgcgccatctgcagcgatgataacctggcgctgctggctcaggtgccggatgacaccgtgctgacgattaaccttctggagggcgtacccggttatcttttcggccccatgtgcccggatgccggttatgtgccttgctttgagctgctgccgtatgctgacggcgtgattatcaattaccctgacaacggtaactggcaggtgctgccgccctttgtagaccagccgcgccttaacgatgcctatcaggaggcagaagaatggtcggccatgattcactgcaatactgtgggcaagctcaataaaattattgatttaggctatgccgaaaagattattcaggtagcggaagcgctgcatgaaaagaagctggctaatattgccgatattttggcaagtcaccatgagctgaagctggtgctgattgcaggtccgtcctcctccggcaagacctctacggcacagcgtttgagcattcagatggcagttaacggcctgcgcccgattgccgtttctatggatgactattataaaaaccgtgtcgattcgccgcgtaaggctgacggcagctatgactttgaatgtctggaggctatcgacctggagctgttcaacgatcatctgcagcgtctgctggctggtgaaaaggtcaaaatgcccaagtacaatttccgcaccggctgccgtgaatatcgcggtaacgagctgcagctgcaggaaaattccgtgctggttatcgaaggcatccacggcctgaatgagaagctgacaccgtccgtaccggcggaacataaaataaaaatttatgtcagtgcgctcacaccgatgtcctttgacgagtataaccgtatccgtactaccgatatgcgtctgctgcgccgtatggtgcgcgacagccagttccgttcgcatgatgcggaaactacgctgagaacctggtccgacgtgcgtgatggtgaagaaaaatacatcttcccgtatcagagcagtgccgatatcattttcaacaccacgctgatttacgaattagctgtgctgaaaaaatatgcggagccgctgctgcgtgctgtaccgcagtccgcaggcatggcctacactactgcgcaccgtctgctgaacattttaagctacgttaagccgttggaggataatgttattcctaataactctatcctgcgcgaatttatcggcggcagtgtgtttaaggacgcactgtaa

SEQ ID NO: 2693 - DNA, 957 bp, Phascolarctobacterium succinatutens
gtgttacaatatatacataaaaaacatattcagaatattttgcttgcaaaggagaattttatgaatcccgctttgaagaaaaaaatttaccattatgctatggtgaccttggcctgtgcgattatgggtattgccatgaataccttttatatgcctaataagatgctcagcggcggcatcggcggcgttgccgtacttgcctattatgttgccggcctgccgatgggcgctaccagcttaatctgcaatgtgccactgttctttttagcctataagtatatggaccgtgaatatactatcagcgcgctgtatggtattattgctttttctgtatctttggatttctttcattttctgtcaaactatactgtagtgcatgacaagctgctggcctgcattgccggcggtgtgctttacggcatcggtgccgcgtgcatgtaccgcgtgggcggctccagcggcggtacggatattatcggcgctattatccagaaaaattattctatctctattagtacaactggttttgccttcaacatctgcctgctgctggccagtgtttccttattcggtattgagccggtgttgtacacattgcttaccttttttgtgatgaccaaaacctgtaatgcgtttacgacaggctttgattataaaaagaaggttattatcatcagcgagcatcacgagaaaattgcggaagcgattattaaaatcgttggccgcggtgttacctatatcagcggcgagggctgctttacgcatcgtcaccgcgagctggttttcgtagtcatcaagctgacacagcttgcgaaggtacgctccattgtgcgagagattgaccccagtgcttttatgattatcagtgatgttaacgatgtcttcggccgtggctttacgcttaagccgtccggtcctaacttccccagacctaaatttccggagaagcatgaataa

SEQ ID NO: 2694 - DNA, 1305 bp, Phascolarctobacterium succinatutens
atgaattatacagaaagcctggcatatttagacagcctgggcaaatttggcattaagctcggtatggagcgtattgaaggacttttgcgtgagctgggaaacccggagcaaaagattaaaacagtgcatgtaaccggcactaacggtaaaggctctgttaccagcatgattacgagtattctgctggcagcaaacctgaaggtgggcaagtttacttccccgcatctggtgaagtacaacgaacgcattaacctcaacggcaaggatatcagcgacgaggattttgctatggcaattactgcggtaaaggttgctgctgacagcgttgtcaaaaagggcgtctgcgagcagccgacgcagtttgagattttgacggctgcagcgtttttatatttttatctgcagaaggttgattacgccgttattgaggtaggcatgggcggcctgtgggattccaccaacgtaattacgccggtggtcagcgttattaccaatgttgcgctggaccataccgaccgctgcggcaaaacgctggagcgcattgctatgcagaaggcaggcattatcaaggagaaggtgcctctggttaccgctgccgagggcaatgaagctcttggtcctattgtaagcctggctatgtttaaggaagcgcctgtttatctttacggcaaggcttttcacggcacggaggtaaaaagctcgatggagggccaggcctttacgctgcatgcaggcgatttttatcattccgattatgaaatcaagctgccgggcgagcatcagattaagaatacgagcgtagctattgtggctgccaagctggtgagcaagcaggatgaccgcattaacgagctggcgctgcatgtgggcgtggccaataccgtttggccgggacgtttggagcgcattcacaagaacccggatattattctggacggtgcgcataaccctgacggtgccaaggctctgcgtaatgctttggataaatattatcccggcaagcaggtgcagtttgtctttggtatgatgggggacaaggatatgagcggtgttatcaaaacgctgattaatcaggatgatgttgtttataccgtgcgtgccgatgagggtgcgcgtgctgcggaggctgcggatttggcgaagctggtgggcagcaatgctgtggcggaggctaatcttgctacggcgtatgatgctgctatccgcggggcaggcaatgacggtgttgtatgtgtttgcggcagcctgtatctggtgggcgagtttaagaagatgctgctggcggataaatgtagaatgaactga

SEQ ID NO: 2695 - DNA, 672 bp, Phascolarctobacterium succinatutens
atgcaaggagaaaggaacaataaaatgacacgtaacaaattcaacgaggagctgaagcagctgctcaacagtgtgcgcgtgatgggcgtaaatctggaggataccctggataaggttatcgccaacctggagcagaaggatgccgccttggcgcagcaaattatcagcgacgatgataattttgacaacagcgaagtaaatatcgaaaagcaatgcctggagctggtgctgacacagactccggtagcaactgactggcgcgagattgccagctgtctgaagttggtgggcgatatggagcgcattgccgaccattgcagcgatatcagccaatacaccttgaagctgattgaaaaggatcctgtgccgctgccggataactttatggctatgctgcatgttatgcgccagatggtgtacgacagcatcagcgccatcagcgaaaatgatttggagctggccaacaaggttattgctaccgatgatgaggtagacaattattttgccgaaatgcgtcagcatctgaccactgtaatgcagcaaaagccgcaatacgtaccccaatatgttgactatctgatgattgccaaatatgtggagcgcattgccgaccattctacgaatatcgcccaatgggtaatgtttgtggtaaagaacgaactgaaaaactga

SEQ ID NO: 2696 - DNA, 933 bp, Phascolarctobacterium succinatutens
atgcataattcatcagcaaataatcatagtactcgcggcgttctcatgctcacgctgtgtgcttttatctggggcactgcctttatcgcgcaaagcgtcggaggcaattacgccgaaccgttaaccttcaactgcgcgcgcagtgttttggctactatatttttgttcggctgctgcctattgttcgacaaagcggcaggtaagcgctttactgttttaggcagtgatgaccctatttataaagaaggtctgcttaagggcggcatcacctgcggcctgttcctctcactcgcgtgttttttccagcagcttggcataatgtacactaccgtaggcaaaagcggctttattacagcactctatatcattctggtacctgttttgagctatatcttctatcgtcgctctgtttccctgctgcagggtctcagcgttgtcgtagcagccgtaggcatgtacttcatctgcatcaacgaaggcttctctatcaacaaaggtgatctatacaccctcatctgcgctttctgctttgccgcacagattatcgccatagaaaatatcattaaaaaccttgacggcgtgcgcctgtcactcatacaatttatgacctgcaccgtggtcaacggtgtgctgatgtttattttcgaaacaccatccatgagcaatattattgcaggctgggcacctattgcctacgccggtattatgtccagcggtgtagcctacacactgcagattgtcggtcaaaaacatgtcagctccctagttgcctgcatgctgatgagtctggaatcagccttcgcactggtaagcggctggcttattttgggacaggctatgagcagccgtgaaatctttggctgtgctctggtatttgcagctattacgctggcacagctgccggaagaaatactgggattaaagaagcgctaa

SEQ ID NO: 2697 - DNA, 1245 bp, Phascolarctobacterium succinatutens
atgctaccagcagctaacgttaagtttacccccttcacggaggatatgaaaaaaacgcatactatacttatacccggcatgctgcctatgcatttttcactgctgcaggcagcactcgtaagctgcggctacaaagccgaggttctgcacaacacaggacgcgaagtaatcgaaaccggtctgaaatacgtcaataatgatatctgctatccggcactgctggttatcggccagctgataaacgctttggaaagcggcaaatatgacttggaacacactgcgctgattatcacccaaacaggtggcggctgccgtgcctccaactatatctatctgctgcgcaaggctttggaaaaagcaggacttacccatattcctgttatcagcctcaatgtcaatggtttggagcagcagccaggcttccatctggatgcatccatggtgcataagttcttggctgccgttgtttacggcgataccctgatgtacctgacgaataaaacacgtccctatgaggttgtacacggcgctgccgacagactggcgcaaaaatggctggcacgcttgagtgaagccttcaagagcggcaaggcgcaggccttgggcactatcaagcagcttactaaggctattgcgcacgaatttgcggatttgcctatcaccaacaaggaaaaaatcaaggtcggtattgtcggtgaaatctacatcaaatatgccgcattgggcaacaacaatctggaagctttcctgcaacgtcagaactgcgaatatatgctgcccggtctgatgaatttcataatgtactgtgttgatacttatcttacggattacaagctttacggcggcagctttatcaaatacagtgtcaacaaaagcgctatgtggtatttgaaatatatggaaggcattctgcatcaggctctcagtatcgctcccttcagcgcccccgccacctatgaggaaactaaggctatggccaagggtgttatcggctacggcaacaatatgggcgaaggctggctactgactgccgaaatgctggagctggtgcatagcggctacaccaatattatctgtgctcagcccttcggctgcctgcctaatcacatcgccggccgcggcatgattaacaaaatcaaggagattgccgaagaagccaatattttggcactggactacgatgccagcgctgcccgcgtcaatcaggaaaaccgtattaagctaatgctggcgacagcgaagtaa

SEQ ID NO: 2698 - DNA, 1317 bp, Phascolarctobacterium succinatutens
atgggggtaagaaacatggcaacaatttggcaacaggctgaagaattaaaagatgaaatggtcgaacgccgcagagatttgcatagacatccggaaacaggctggacggaattccgtacggcaagcatgattatcggtgagctgaaaaatcttggctatgatgttaaattcggcgatgacgttattgacgaaaaatctatgatgggcgtgccgagcgaggcagagctggctgattatatgcaaagagcaatcagcgaaggtgcggatccggagctggtaaagaagatggcaggcggcaagaccggtatcgtggcaactcttaaaacagataaacccggtaaaacagttgccttccgctttgatatggactgcaacgatgtagaagaggagcgcagcgaggagcatcgcccagctaaggaaggctttgcttccgaacataaaaaggctatgcatgcctgcggtcatgacggtcacgtaaccatcggcctgtcggcagcaaagctgcttgccgccaataaagcacgtttggcaggcaccataaaattgattttccaacctgcggaggaaggtgtacgcggtgccttcgctatgatgaacgccggtgtagttgatgatgtcgattatctgttcggcggtcatatcggcttcaaggctactacaaacaactgcctggtaacgatgactgacggttttctggcaactacgaagctggatgcggaatttaccggtgtgtctgcccacgcaggcgctgctccggagcagggcaagaatgctttgttggcagcagcacaggctgcaatttccctgaataccattccccgtaacagcaagggctccagccgtatcaacgtaggcgtactcaacgccggcaccggacgcaatgttgtgcctgatatcgctgctattaagctggaaacacgcggtgctactaccgaaattgatgaatacatggttaccgaggctaagcgcattcttaatgcctgcgccgctatgtatgacgttaaggtaaaaatcaccatggccggggctgcacctgcctgctttgcagacaaggagctgggccatgaggtagcagagctgattgaggaaaaatgtcattatgacgaggttgttgaatatgtggacatgggcggcagcgaggactgcggttacttcatggagcgcgtacagcagcacggcggccgtgctctgtatatgatgtacggtaccaaaatcgccgcaggtcatcacaacagtcacttcgatttcaatgaggattgcctgtggaaggctgctgctaccgttacggaaatcgccgtacatttcagcaacaagtaa

SEQ ID NO: 2699 - DNA, 1461 bp, Phascolarctobacterium succinatutens
atgaatgcaaaggttataatatatctcctgggaaaaatttctgccggcctggcaattgcacagctgttgccgcttttgatgtctgttgtttacggcgaatatgctacctccagaacctttatcttttccatagcggtagctgttattttggccgggatctttgattattatggtgacggtagaggagcacgcaatttatccgtgcgcgagggtatcggcacggtattcttttcatggcttttggctgctgccctgggcgcgctgccttattgctttgacggcattttgaatcccgccgccgcctactttgaaagtatgtccggactgaccactaccggcgcaacggcgattgccaatcttgacatagtatcgcgcagcttgcttttgtggcgtacgctgacgcactggattggcggtatcggcatcatcgtgctgttcgtagcgctgctgccgcagattgccggtggtgctgtgtatctttttaatgcagaggtcagcggcttttccaacagccgtattctgccgcgtatccgtacaactgcagtagcgttgttctatatctatctgctgtttacgattattcttaccggtatgttggcaattttgggcatgagcacctatgatgctgtcaatcatgcctgctctgcgattgctacaggcgggttttctacctataatgacagcattgcgcattttcacagtgcgggtattgagattgttactggtctgtttatgattttggcggcaggcaacttcgccttatactatcaggttacgcaaatcggcctgaaggttttgtggcatgatctggaattcaaaagctacattgtgttgctgactattttcactgttttaatcagcatcaacatcattatggtgaatggctacagcgtggcagacggcgtacgcgaggctttcttccaggtggcttccttcggcagtaccacgggttatgtttcggcggactacgaccagtggccgtctttctctaagctgattttggctgtaaccttcctgacaggcggctgcgcaggttctactgccggcggtattaaggtctgccgttttatcgtactgctgaaaacagttatggcggagctgcgtcgcactatgcatccgcagatgctgctcaacgtttactacgctaaaagacgtctgccgacagaaacgattatcaacgtcagccgtttctttttcgtttatgttctggttatcgcaattttaactatgctgctctgcttaagcggtgtagatgtagatgaggcagttttcggcgtggcctcctgtatttccagtgtcggtcctgcgtttggcagtatcggtgctacgggtaactatgccggtgttaccggtatgggacagcttacgctggcgttggctatgcttttgggacgcttggagctgtttaccgtgctggccttgcttcgcggtgaatactggctcagtagcaaaagatggtaa

SEQ ID NO: 2700 - DNA, 966 bp, Phascolarctobacterium succinatutens
atggtaaaagcattgtatgatggccgtctggcagttgatattgccggcctgaaaatggctactcctgttactaccggctccggcacctttggctttggcctggaatttaccgattttctcgacctggaaaaggttggcgctgttaccgtaaagggtacctccttagagcctgcggcaggcaataagggccagcgtgcggtagaaaccccgtccggtatgctgaactgcatcggtcttgaaaaccccggcagtgagtacttcttggagcacactctgcctgagctgaaaaaatataatgttcctgtgattgtcaacatttacggccatactcccgaggaatacggcgctgttgccaaaaagctggacgtagacggtgttgatgcagtagaaatcaacatctcctgcccgaatgttaaagagggcggcattgttttcggcactgtgccggaagcagctgccgaagtcgtacgtgcggttaaggccaacaccggcaaaatggttatcgccaagctttctcctaatgtaacggatatcgtggtaatggccaaggctgtagaggcagcaggtgcggatgcaatttccatgattaatacgctgctcggtaccaagattgatattgagcgtcagcgtcctgtgcttggcaatgtaaccggcggcctcagcggtcctgctgtacgtccggtagcagtgcgcctggtttaccaggtagcgcaggctgtgcatatccccatcatcggcatgggcggcatcatgtgtgccgaggatgcaattgagttcatgctggcaggcgcaagtgcggtagcagttggtaccgcaaactttgtacagcctgatatcgctgaaaccattgcccatggtatgctggcatatctggacagacacaacgcgcagaacatttctgaaattgttggtctggctttgccaaacggcaaagcaagcatgccgttgtttaacgacgctgtataa

SEQ ID NO: 2701 - DNA, 3990 bp, Blautia sp.
atgcctaaatggcgccattgtttaaccgaaaaagcagtgagtaaatatataaggggtgaaatgtcaatggaaaagaacagaatcaaacctaccaagtcaggacgcagcatgagaatgagctattcccgtaaaaaggaagttcttgatatgccgaacctgatcgaggttcagcgcgattcctaccagtggtttctggatgaaggattgagtgaagcatttgcggatatttctccgatcaccgattatagtggcaagctcagcctggagttcaccaactttacgcttgacgtggaaggtgcaaagtacacaatcgaggagtgtaaagagcgcgatgcaacatatgcggcaccgttgaaggtcagagttcgtcttcataataaagagaccgacgagatcaatgagcacgagattttcatgggcgatttgcctctgatgaccgagaccggtactttcgtgatcaatggagctgaacgtgttatcgtcagccagctggtacgttcaccgggtatctattatggaatcgatcacgacaaagtaggtaaacttctgttttcctgtactgtgattccgaaccgtggagcatggctggagtatgagactgactctaacgatgtattttatgttcgtgtagacagaacccgtaaagtgccgatcactgtgctgatccgtgcactcggatacggtacaaatgcagagattatcgatctgtttggtgaagagccgaagatccttgcatctttaacaaaagacacttctgagagctatcaggagggtctgcttgagctgtacaaaaagatcagaccgggtgagcctctggcagtagagagcgcagagtctctgatcacaggtatgttcttcgatccgaagagatatgatctggcaaaggttggccgttataaattcaataagaagcttcatctgaagaaccgtgtatgcggtcaggtgctggctgaagatgtagtagatgcttctactggtgagatcatcgcagaagcagataccaagatcgatcatgatcttgcagtaaaactgcaggattccggcgttccgtttatctgggtaaaaggtgaggaacgtaatatcaaagtgctctccaaccgtatggttgacctgagcaaatatgtagatttcgatctccatgagatgggaatcaaagagtctgtatattatccggtgctggagaagcttcttggagagtacacagatgctgaagagctgaaagaagcaatcgaaagagagatttcagagctgattccgaagcatattaccaaggatgatattatggcatctattaactataatatgcatctggagtatggtcttggaaataaggacgatattgaccatctgggcaaccgtcgtatccgtgccgtaggtgaacttcttcagaaccagtaccgtattggtctttcccgtctggaaagagtggttcgcgagcgtatgacaactcaggatccggagagcatttccgcgcagaccctgatcaatatcaaaccggtgactgcagctgttaaagagttctttggttcttcccagctgtcccagttcatggaccagaacaacccgctgggtgagctgactcataagagacgtctgtccgcacttggacctggtggtctgtcccgtgatcgtgcaggattcgaggttcgagacgtacactactctcattatggaagaatgtgcccgatcgagactcctgagggaccgaacatcggtctgatcaactctctggcatgttatgcaagaatcaacgagtatggattcgtagaggctccgtaccgtaaaattgataaaacagatcctcagaatccgcgtgtaaccgacgaggttgtttacatgactgctgatgaagaggataattaccatgtagcacaggcaaacgaggcactggatgcagagggacatttcctcagaaacagtgtatctggacgtttccgtgaggagactcaggcatacgataagaccatgtttgattacatggacgtatccccgaagatggtattctccgtggctaccgctctgattccgttcctgcagaatgacgatgctaaccgagctctgatgggatccaacatgcagcgtcaggccgttccgctgatgctgacagaggcaccggtcgtaggtactggtatggaagagaagactgctgttgactctggtgtctgcgttgttgcgaagaatccgggtactgttgagcgtgcagtctccaacgagatcgtgatccgtcaggataacggtgttcgtgatgtatatcacctgaccaagttctccagaagtaaccagagcaactgctacaaccagagaccgatcgtattcaagggagatcgtgtggctgcaggcgaggtaatcgcagatggtccgtccacttccggcggagagatcgctcttggtaagaacccgttgatcggattcatgacctgggaaggttataactacgaggatgcggtactgttaagtgaaagactggttatggatgatgtatatacatctatccatattgaggaatatgaggcagagtcccgtgataccaagcttggaccggaagagattaccagagacgttccgggtgtcggtgatgatgcactgaaagatctggacaacagaggaatcattcgtattggtgcagaggttcgtgccggcgatatcctggttggtaaggtaactccgaagggagagactgagctgactgctgaggagcgcctgctgcgtgcgatcttcggtgagaaggcaagagaagtgcgtgacacctctctgaaagtaccgcacggtgagtatggagttgttgtagatgccaaagtatttaccagagagaatggcgatgagttgtctccgggagtaaatcaggcagttcgtatttatattgcacagaagagaaagatctccgttggtgataagatggcaggtcgtcacggaaacaagggtgtcgtttcccgtgtacttccagttgaggatatgccgttcctgccgaatggtcgtccgctggatatcgtgctgaacccgctgggtgtaccttcccgtatgaatattggacaggtcctggagattcatctgagccttgctgcaaaagcgcttggtttcaatgtatctactccggtatttgatggtgcaaacgagcatgatattatggatacccttgatctggcaaatgattatgcaaatctgccgtttgatgatgcagaagctgcagagtggaaggcaaaaggcctggatcagactgctgatggcaagccgtgggccggcgagacatttgttggaaaacatggagaagatcttcttccggatgttctggattatctgtctgagaacagagaacacagaaaattatggaaaggtgttccgatctcccgtgatggaaaggttcgtctgcgtgatggccgtactggtgaggaattcgatagcccggtaacaatcggtcacatgcattacctgaaactgcatcatctggtagatgataagatccatgcacgttctactggaccgtactctctggtaacacagcagccgctgggtggtaaagctcagtttggtggacagcgtttcggagagatggaggtatgggctcttgaggcttatggtgcttcctacacactgcaggagatcctgacagtaaaatccgacgacgtgatcggacgtgtgaagacctacgaagcaatcatcaagggcgacaatattccggaggcaggtattccggagtccttcaaggtactgcttaaagagctgcaggcacttggactggatgtacgtgtgctgcgtgaagataacacagaggtagagcttggtgagaacatcgattatggtgatgttgatatccgttctatcctggaaggcgacagcagacgttttaacaataacaatgatgaatcctttggagaccatggcttcagcaagcaggagttcgatggcgaagagctggtagacgtcagcgaagatgacgactacgatgatgacgagtctgtcgatgcagatgaagatatgggatatgatgaatag

SEQ ID NO: 2702 - DNA, 3156 bp, Blautia sp.
atgtacagcaaagtaaacaccgacatgaactttgtagagcgcgaaaaagaagttgaagagttctggaaagaagacaacacatttaagaaaagtatggagcagagagaaggctgcccgacatataccttttatgacggaccgcctaccgcaaatggtaagccgcacatcggtcatgtgctgacccgtgttatcaaggatatgattccgagataccgtaccatgaaaggctactatgttccgagaaaagcaggctgggatacccacggactgccggtagagctggaggttgagaagcttctgggtctggatggaaaagagcagatcgagcagtatggtctggatccgttcatcaccaaatgtaaagagagtgtctggaaatacaagggaatgtgggaggatttctccggtaccgttggtttctgggctgatatggataatccgtatgttacctatgatgacaacttcatcgagtccgagtggtgggcactgaagacgatctgggacaaaggactcctgtacaaaggattcaagattgtaccgtactgcccgcgttgtggaactcctctgtcttcccatgaggtggcacagggatacaaagatgtaaaagagcgttccgcagtggtacgtttcaaagtaaaaggtgaggatgcatatatcctggcatggaccactacaccgtggactctgccgtccaacgtggcactttgtgtaaacccgaacgaggagtatgcaaaagtaaaagctgctgacggatatgtatattacatggcatccgcacttctggataccgtacttggcaaactggcaaaagacggtgaggctgcttacgaagtactggagacctacaaaggtaaggatctggaaggcaaagaatatgaggcactgtatcagtgtgcagcagatctggctgcaaagcagcacaagaaaggtcattatgtagtatgtgatacctacgtaactctgaccgatggtactggtgttgttcatattgctccggcatttggtgaagacgatgctcaggttggccgtaaatatgatcttccgtttgtacagttcgtagatgaaaaaggtgatatgacaaaagagactccgtttgcaggtctgtttgtaaagaaagcagatccggaggtgctcaaagacctggatgcaaagggacttctgttcgatgcgccaaaatttgagcatagctatccgcactgctggagatgtgatactccgctgatctactatgcacgtgaatcctggttcatcaagatgacggcagtgcgtgatgatttggtacgcaacaacgagactgtaaactggatcccgcagagcattggtaaaggtcggtttggaaactggctggagaacattcaggactggggtgtatcccgtaaccgttactggggaactccgctgaacgtatggcagtgtgaagactgcggacatcaggaagcaattggttcccgtgagcagttaaaagagctgagcggcaatgagaaagctctgactgttgagcttcatcgtccgtacattgatgagatcacttgcacttgcccgaagtgtggcaagactatgaagagagtaccggaggttatcgactgctggtttgactcaggagcaatgccatttgctcagcatcattatccgtttgagaacaaagacctgtttgaacagcagttccctgctcagtttatttccgaggctgttgaccagacccgtggatggttctattctctgatggcagagtctaccctgctcttcaacaagagcccgtatgagaatgttatcgtgctcggacatgttcaggatgagaacggtcagaagatgagcaaatccaaaggaaatgcagtagatccgtttgatgcattacagacctacggtgctgatgcgatccgctggtacttctacatcaacagtgcaccgtggctgccgaaccgcttccatggcaaagctgtacaggaaggtcagagaaaattcatgggtaccctgtggaatacctatgcattctttgtactgtatgcaaatattgataattttgatgcaaccaaatataccttagataagaaatccctgacggttatggatcgttggatcctgtccaaactgaattccaccgttggagcagttgatgacaatctggcaaattaccgcattccggaagctgcaaaagcactgcaggagtttgtagatgatttaagtaactggtatgtaagaagaagccgtgaacgtttctgggcaaagggaatggagcaggataagatcaatgcttatatgactctgtatactgcgctggtaaccatctgtaaagcagcagctccgatgatcccgttcatgacagaggagatctaccgcaacctggtatgcagcatcgataagaccgctccggagagcatccatctgtgtgacttcccgacagtagaggctgagatgatcgacaaagatctggaggcttctatggaagaggtccttgatatcgttgttatgggccgtgctgcaagaaatactgctaacatcaagaaccgtcagccaatcggaaccatgtatgtacgtgcagagcgtccgctggatgcaatgttccaggaagttgttgcagatgagctgaatgtgaagaacgtagagttcaaagaggacttaagtgatttcaccagctacaccttcaaaccgcagctgaagactgtcggaccgaaatacggaaaacttctcaatggtatccgtgcacacctggctgagatcaatggccgcgaggctatgaaagagctggacaacagcggaagcctgtcatttgacattgacggacagaaagtggtattatcaaaagaggatttgctcattgataccgcacagatggaggggtacgtgacagaagaagacagcactgtgacagtcgttcttgatacaaatctgagtgaggaactcattgaggagggatttgtaagagagatcatcagtaagatccagaccatgcgtaaagaagctggatttgaagtgatggacaagatcgtggtatacagcatgggcaatcagaagattgaaggctacatgaaggaataccgtgaggaaatcttaagcgacgttatggcatcagatatccgttttgacgaggtaaaaggatatacaaaagagtggagcatcaatggtgaatccgtaacacttggagtggaaaaacagtaa

SEQ ID NO: 2703 - DNA, 3483 bp, Blautia sp.
atgaattttacacatttacatgtgcatacagaatacagtctgttggatggatccaataagatcaaggaatatgtggcaagagtcaagaaactgggcatggacagtgcagcgatcactgaccatggtgtcatgtatggtgtgattgatttttataaagaggcaaaagctcagggaatcaagccgatcctgggatgcgaggtctatgtggcgccaggttcccggtttgacaaagaggcaggaaataacgaagatcgttattatcatctggtgttgctggcggaaaataacgagggctaccagaacctgatgaagatcgtatcgatcgggtttatcgatggattttactataagccgcgcgtggatattgagacactggaaacatatcatgaaggtatcattgcattaagcgcctgcctggcaggagagatcccacgctatatcatgcgtggaatgtacgaggaagcatgtaaatctgctctacgctatcagaacatctttggaaaaaataatttctttctggagctgcaggatcatggcatgccggaacagaagcaggtcaatcagtcgctgcttcgcatgagcagggagatgggaattgaactggtggcaaccaatgatgtgcactatacgtatgcggaggatgtgaagccgcatgatatcctgctctgtctgcagactggcaagcggctgtcggatgaggaccgtatgcgttatgaaggcggtcagtattttgttaaatccccggaagagatggcaacgttgtttccctatgcacctgaagctttggaaaatacgtataagattgcacagcgttgtaatgtggagattgagtttggcgtgaccaagctgccgaaatacgatgtgccggaaggctatacttcctgggaatatctgaataaattgtgctgggatggatttgcagagagatatccggatgataccggaaaattgagagatcagctgacctatgagttgtccattattcagaagatgggatatgtggattatttcctgatcgtatgggatttcatcaagtattccagagaccatgggattgctgtgggacctggacgaggttctgccgcaggaagtctggtttcctacacgctgggaatcacgaatattgacccggcaaaatatcagctgctgtttgagcgttttttgaacccggagcgagtatccatgcccgatatcgatgtggatttctgttttgagcggagacaggaagtcatcgattatgtcgtccgtaaatacggcaaagaccgggtcgcacaaatcgtgacctttggtacactggcggcaagaggtgtgcttcgtgatgtggggcgtgtgatggatatgccctatgcctttgtggattccattgcgaaaatggtgcctcaggaactgaatattacactggatcgggcgttgaagaccaatccggagtttaagactttatatgacaccaatgagcaggtaaaagagctggtggatatgtccatgcgcctggagggactgccacggcatacatccatgcatgcggcaggtgtggtcatcagtcagaaggcggtagatgaatatgtgccgctctccagagcacaggacggatcactgaccactcagtttaccatgaccacattggaagaacttggacttctgaaaatggatttcctagggctccgtaccctgactgtgatccagaatgctgtgcggatggtcgagcagggacatggctgcaagattgatgtggatcacattgattacaatgataaagcagtgttggattctttgggaaccggtaagacagatggcgtgttccagctggaaagtacgggtatgaagaatttcatgaaggagctgaagcctcagagcctggaggatattatcgcaggtatttccctgtatcgtccaggtcccatggattttattcctcagtatatcaggggaaaaaatcatccggagacgattacttacgactgcccgcagctggaatcgattctggaaccgacctatggctgtattgtctatcaggagcaggttatgcagatcgtgcagaagctggcaggttatacactgggccgtgcagacctggtgcgccgtgccatgtcaaagaagaaggcagctgtcatgcagcaggaacgccagaactttgtatatggaaatgaagcggaaggcgtacctgggtgtatttccagaggtatcccggaaaatgtggcaaataagatctatgatgatatgattgactttgcaaaatatgcatttaataaatcccatgcagcggcttatgcggtagttgcctatcagactgcgtggctgaaatattattatccggtggaatttatggcagcgttgatgacatctgttatcgataattcaacaaaagtgtccgagtatattctgacctgtcggcagatgaacatcggtattcttgcaccggatgtaaatgagagtgaaagtgcattttccgtgtccggtggagccatccgttatggcctgaatgccatcaagagtattggtcgtccggtgatcgagagcattattgcagaacgaaaagcagggggaccgtatgtagatctttctgattttatccatcgtctgccaggcaaagatgtgaataaacgtgtagtagaaaatctgatcaagtcgggcgcatttgacagctttccggcgaaccgcaggcagatgatgctgatctacgggcagatcatggatgaggcagcgcagaaaaagaagacagaactggcgggacagatgagcctgtttgattttgcggcagaagaggataaggaagctttcaaagtgaagattccagtagttgctgaatataacaagggagatttgctggcatttgaaaaagaggtactgggattttatatcagtggccatccactagaggaatatgaagagcagtggaagcgagggatcagccatgtgaccacagattttctcccaccggaggagggagaacttccgaaggttcatgacggggagcgtgccaccgtgggaggcatgattaccactaagacgatgaaagccaccaagaccaataaaatgatggcattcatcaccattgaggatctggtgggaaccgtggaagtgattgtatttccaagagattatgaaaagatcggaaagatgctgaatgtggatgataaagtgtttgtaagcggacggatttctgctgaggaagatcgtgccagcaagatgatcctggaaagcatccgcccgttttcagagccgaagaaggaactgtggatccagtttacggatgtggaagagtttaaacgccgggaaccggaactgttgtcaacgatcatggacagcgaaggcagcgacagtgtgatcatctatgtaaaaaaagaaaaaatgaagaaggtgcttcctgccagccggaatattaagatcacagatgagctcctggggcggctttatcagatatttggagagaaaaatgtaaaagctgtagagaagtatattgaaaatacaggaaaaatgcattaa

SEQ ID NO: 2704 - DNA, 2349 bp, Blautia sp.
ttgagaaagctggcagaacttattgtaaataatcgtaagctgttgatggtgatctttatcgcggcagcgatcggtagtgccatcatgtcatcccatgtggaagtcgtacaggaactgacagattatcttccagaagacactgagaccagacagggagttgatctgatggacgctgagttcacgacctttggtacggcaaaggttatgatctcaaatgtaacgtatgaagaagcgaaggatatcgtagaacagctcaaagacatcaagggcgtatctgcggtggacttttatgaggaaagtgatgaggacgagacagagattacagatggggaagaactgtctgattactacaaaaatctgtccgcacttctgagtattacttttgacacaccggaagatgatccggaagcacagggtgcaatcaaagatgtgagggaagcactggccgattatgatacctggttctacacgacggtagataaagatgataatgcgtcactgcaggaagatatcaaggtcattctggtgatcgctgtatttattattatagctgttctgtggtttacatcaggaacctatatggagattgctattttcatgcttgtatttgccatggcggcactcctgaatatgggtaccaactttatatttggaaagatctcttttgttaccaatgcagtagcatccattttgcagcttgctatggcaattgattatgcgattattctgttccatcgttttatggaagaaaaggcgcatacggatacgaaggaagcgttgatccgggcactggaaaaaggcattgtggagatatcatccagttctctgacaaccatgtctggtatggtggctctgatgtttatgcattttggtatcggactggatctgggtcgtgtcatggtaaaagctattctgttaagtatgctttctgtattcggatttatgccgggactgattatgatgttcaatcgtcagatcgataatacaatgcataaaagttttgtgccgaagatcgagttctggggaaaaattgttgttgcggtcagaaaattcacggtaccagtatttgttgtaatgatcttcgtgtgcggatatctgtctaataccagtacctatgcttatgaccagagttccgtggaatctgcaaagatgaatgaatatatgacatccaagcgagagatttccaagaattttgatctggataatctgatggctattgtagttccggcaggagattatgacagcgaggctgcgattctgtcggagattcaggagatcgacaatgtggcatctgctacaggtcttgccaatgttacggtagatgatgatgagcagtatgtactgacagacagactgactcctcaggagctggcagacgttacagatatggatattgatacgatccgtcttttgtatcggttctatgcatggaaggaagagaaatacggtgcatttctaaattccattgatgagttcaagattccgctgatctccatggttgattttatctatggagaggaagaaaacgagacctttgattttgacgaggatctgtcacaggatatcaaagatatgcacaagaccctgtctgatgcgagagaacagctggagggagataactaccatcgcatgctgtttacaatctccggaccggtggaaggagaggagacctttgcaacgatcgacaaggtaagagatattgcgcagaaatattaccatgaagtgtatgtagtaggagattccaccagtgactatgatctgagcaaatcttttacgcaggataatatgatcatcacgatcctgacagcattgttcgtggccttgatccttctgtttacatttaaaaattatagtctgccgttgatccttgtggttacgattcagaccagtatttttatcaacttcacgttgccggcgatccagggagtacatatgtatttcttgagctatctgatcgtcagctccatccagatgggtgcaacgattgactatgcgatcgttatcacaaaccgctatattgatttgcgaaagacgatcactgacaaacgcgaggcagtggtcaagacgctggatcagagttttgctacgatcattacatccggttctattatgacatctgccggattcgtagttggtcagaccaccagcaacccggttattgcctcattgggaacgactcttggaaaaggaacactgacctctattgttctggttatgttgatcctgccgcagcttctctatatgtttgacggtatcattgccaagacttattacaagagcaagctgtcactggaaaacttaagtaaattaagagcagaagcagctggtgaggagggacagaaagcatga

SEQ ID NO: 2705 - DNA, 2049 bp, Blautia sp.
atgggaaaactcgggaaaataaaaggaaagcttcggctttatatcaaatggccgttatatctgacgcttctgctgctggtggccgggttgggtgtttatctgatctcaccgcaggcagggctgcttatggtaatcgtgatcatcatttatgcagcgattgcaggaggtctgtatatatataacaagccatcgatctatacagatatggtgtcctttgcgacccagtatggacagatccagaagaatctgctgaaggagctggcgattccctatgtccttttgagtgaggatggacggatcgtgtggagcaatcgggagttcaacaggatcacaggaaagatcgggaaatttaataaagcgatcaatacggtatttccggaactgaaccagggactgcttcctacagaagaagagccagtcgtttctgtgaatctgaagtacggagaagaagattaccgggtggagatgaaacggatccagatggatgagtgtctgccaaatgctgaagagctcatcgagtcggaagctgtggaaggctgcctgatcgctctgtatctgtttgataccacggagatcaaccgtcggatcagagagaatgaagaccagcgtatggtagttggtctggtttacattgataattatgatgaagctctggaaaatgtggaagaagtcagaagctctcttctggtggcgctgatcgagagaaagatcaacaagtatttcggggcttatgacggcattgtgcgtaagctggaaaaagacagattttttgtagtcatgcaggaaaaagcactgacacagatccgtgagactcgttttgatctgctgcaggatattaagaccgttaatattggaaatgagatggctatcacattaagtattggtattggttccggcggcggttcctatacggattgtatggaatatgccagaagtgccatggatctggctcttgcaagaggcggagatcaggctgtggtgaagacgaaggatcagatcacttattacggtggtaagacccagcagatggaaaagaatacgcgtgtaaaggcgcgtgtcaaagcacaggcattccgagagctggtggagaccaaggataaagtggtcgttatggggcataagatgccagatgcggatgcatttggttctgcagttgccatttatcgagctgcgaagaccttgaataagaaagcctatattgtcgtcaatgaggcaacgtctgccatgcgtccaatgatggaagcatttgcggaggccaacaatcatgagcagggaatcgtgattggcagcagtcaggcaaaagaaatcgtagaccgcaatacggtggttgttgtggtcgataccaacaagccaagttataccgagtgtgaagagattcttgccatgacaccgacggtcgttgtatttgatcatcaccgcagaggcaatgaggtgatccagcatgcggcgctttcctatgtggagaccaatgcctcatcttcctgcgagatggttgcggagatccttcagtattttgcggataatgtaagactgaagggcggagaagccgattgcatctatgcaggtattatgatcgatacagacaactttatgagaaaaacgggtgtgcgtacatttgaagcggcagcgtttctgcgccgatgtggtgccgatgtgaccagagtccacaagatgttccgtacggacatggcagaatataaggcgagagcggaggcagtccgccatgcagaggtatataagggatttgcattaactgtgtgcccgtccaaagggctggcaagtccgacgatcgtcggtgcgcaggcggccaatgagcttttgaatattgtgggagttcgcgcatctattgtgttgacggaatataatggcaggatatatgtaagtgcaagatctattgatgatgtgaatgtacaggtcatcatggagaagatgggtggcggaggtcatctgaatatggctggagtgcagctggaatgtacactggaggaagcgatgcagcaggtgcgtgatactctggattgtatgttcgagaaaggagaactggaataa

SEQ ID NO: 2706 - DNA, 2532 bp, Blautia sp.
atgagtgaaaaaatagttttaattgatggtcatagtattattaaccgtgctttttatggagtgccggatctgaccaattctgatggactccataccaatgcaatctatggatttttgaatattatgtttcggattctggatgaggagaagccggattatctggcagttgcatttgatctgaaggctccaaccttccgccatcagatgtatgatgcttataaaggaacgagaaaacccatgccggaagaattgcgggagcaggttccggtattaaaggaagttttgcaggctatgggtattccgcttttgatgaaagaaggatttgaggctgatgatctccttggaacggcggcgagagtcagtgaggaaaaaggaatcaacgctgttattgtatctggtgacagggatctgttgcagctggcaacggacaatgtgttgatccggatgccaaagaccaaaagaggaaccacagagatagaaaattattatgcggctgacgtgaaggaagcttatcaggtgaatccgcctcagatcattgaactgaaggcattgatgggtgatgcttctgataatattccgggtgtgccgggaatcggtgaaaaaacggcaactaatctgatcgtagcatatggttctattgaaaatgcttatgcacatgtggaagagatcaagccaaatcgtgcaaaagaagctcttcgtaaccattatgacatggctgagatgagtaaaaagcttgcaaccatctgtgtgcaggctccattagaactgtcatgggaaaatgcaaagcttaccaatctttatacgccagaagtgtatgagtggttcaagaagctgaattttaaaaagcttctgtccagatttgatttgacaggaacggaacttccttcagtgccggaagtgaagcggataacagagctgggtgaggcggaaagtatttttgcaaaggcagaagaccaggatcgcctggcgtttgaaatctgtcagtccaaggatgaatttggcatctctctggcactgtccgaacaggaagtttattatttagcagcagaaggatttctgaccgaggaatacctgacagatcatatgacacaagtggtggaacaggtgcctttgtgtgcggcttcggacgtgaaaaaactgttgaaaatggttcatccggtacacagagagcatttcttcgatattgaaattgcagcatatctgatcaatccgctgatcagcagctacgcacatgaggatatgggaacacctcatgcggcattgaccacgttgaaaaaactgccggaattattgaataagcttgatgaaatggaaatgcgctctttgtttgatgaggttgagatgccattggtatttaccttgtttgatatggagcaggaagggatgcgagtcaatgcagaagaactgaaagcatacggcgaagcactggtggacaagatcagtgcattggaaaagagcattcatgaggcagcgggagaagaattcaatatcaattccccaaagcagcttggtgtgatcctgtttgaaaagctgggcatgaaaggtggtaagaagaccaagaccggttattctacttctgcggaagtgcttgataaactggcaccggaacatccgatagttcgggatattctggaataccgacagcttaccaaattaaaatccacctatgcagatggcctggcaggatgcattgcggcagatggtcggattcatagtagtttcaatcagacgattacggcaactggtcggatcagcagtacagagccgaatcttcagaatattccggttcgtatggaactgggacgcctgatccgaaaggtatttattccatcggatggttatgtatttgtggatgcagattattctcagatcgaactgcgtgtgctggcacatatgtcaggtgatgaaaaactgatcgaagcttatagacaggcagaggatattcaccggattacagcttcgcaggtatttcatgtgccctttgatgaagtaacaccacttcagagaagaaatgcaaaagcagtaaattttggaattgtttatggcatcagttcctttggcctgtcgcaggatctgagcatttctacgaaggaagcaaaggaatatattgaccggtattttgaaacttatcctggaatcaaggtatttcttgataagctggtacaggatgcaaaagagcagggatatgtgactaccatgttcggaagacgcagaccggtgccggaactgaaatcttctaattttatgcagcgttcttttggtgaacgtgtagctatgaactctccgatccagggtacggctgcagatattatcaagattgccatgaaccgggttcatgaccgtctgctaagagaagggctggagtcccgcctgatccttcaggtgcacgatgaacttttaatagaagcaaaattgtcggaagcagatcaggtggagcagatcttgcgggaagacatgcagcaggcggcagatcttcaggttccgttggaaatcgacctgcatagaggaaataactggtatgaggcgaaataa

SEQ ID NO: 2707 - DNA, 1959 bp, Blautia sp.
atgaatataaatacagagaatgaacatattctggtatgtttgtcatcctctccatcaaataagaatattatctttaccgcttccaaaatggcaaatgcattgcaggcacaatttactgctttatatgtgcagacaggagcaaggatccagtcagaagataaagaaaggctggatgagaatattcgttttgcagaggaactaggagcagagattgtaatgacacatggggaaaatgttccattgcagatatcagagtatgcacagctgtccaatgttactgaaattgtgatcggccagagcagtatgaagaggaattattttttcagcagaaaaacattgactgaaaagctgatcgatattgtccctgatatcgatattcatattatacctgatacggtgaaagcagaaaattacagaaaaggacatttgcccctgcatgtggagaagccatcgataaaagagtgttttctgacggttcttatctttgtcatctgtacattcataggacttgtgtttcagaaatttcatttttcagaagccaatgttgtgaccatttatattcttggggtattgcttacctcaattttgacagatggatatctatgcagtgttgcgggttctgtcatgagtgtctttcttttttgcttttttctcaccgagccaaggatgtcatttcagacctatgcagtgggatatccggtgacatttgtgatcatgctgatatcatctgtgctgacagggacactggctgcaaaattgaaaatgcatgccaggctatcagcacagctggcatttcgcacgcagattctgtttgacacggatcgcctgctgcaaaaggcgaggagccagaaggagatacttgagatcacatgtacacagctggcacgtctgtttgaccgcagcattgtagcgtatgctgcagtaaatgggagactggcagaaggacatctgttttccgaaaaagaaaaagcggaagaccagtcctatctgacattggatgagcagcagattgccagatgggtatatacgaacaaaaagcgagcaggagcaacaacgcattattataaaaattcgaaatgcctgtatctggcgattcgtattggagagcaagtatatggagtcattggtgttcctgctcagaaaaatgtattggattcgtttgaatacagtattttgctgtctgtgcttaacggatgcgctcttgccatggataatgccagaaacgcagaagaaaaagaaaaaaatgcagtgatcgcaaaaaatgaacagcttcgggctgatctgctgcgtgccatatcacatgatctgcgaacaccgttgtgctcaatatcagggaatgcggatatgctgctcagtaatggaaaatatctggatgaaggaacaagacggcagatctatacggatatttatgatgacgcagagtggctcacaggtgtagttgagaatctgttgtctattacaagactgaatgacgggagattaaagtttaagtttacggatcagcttatggacgaagtgattgcggaagctttgcgtcatatcagccgaaagcatgatgattacaagatcatcacagaatgtgaagacctgcttcttgcgagaatggatgtaagacttattattcaggttcttgttaatctggtggacaatgcaataaaatataccccttctggttcggcaattacaataagagctctgaagaaaaatgaaaaagcgtggatcagtgtggaagataatggacctggaatttcagatgagataaaaccgcatatcttcgaaatgttttttacaggagggaacaatattgcggatagtcaacgaagtcttggattgggacttgcattgtgtcagtccattgtggaagcacacgggggaaaaatggaattagaagacaacgatccgcatggctgcattttctcgtttgcattaccattaagtgaggtgatattgaatgaataa

SEQ ID NO: 2708 - DNA, 2283 bp, Blautia sp.
atgaaatgtattgtgctggcgggaggaagcggggaccgtttatggcccctctcccgcaaaaattatcccaaacagtttattcatatcaaggaaaaccgctccttgtttcaggagactattgccagaaatatcccattttgcgaggaattttatattattacatccaatcggtatgccaatatcgtagaaggacagctgcaggtctttcagggacttcgttatcgatgcttttacgaggaagagggtaagaaaactgcccctgcggtagctattgcctgtctgtgtgacaaccgttcagaggattatctggtggtatccacagaccatatgatcgaaggtggagattataagggcgccatcgcaaagggtcgggaatatattccgcagggaaagattgtgtgtcttggcattcctgcctggcggtttgagcctggatatggatacttcagacaggtggaagaacggacagagtttcggcacagcgatatgacagaagagatcccggcaggagaaaaatggtactatgataccggaatcttattgtttaatggtggggattttcttcatgaactgtccagaaaatcaccggctctctatgctcagatcagagaatgtgtggatcagcttgatacctacgagagaaatgttctggtgccgggcagacttgtggaagaactggagccggtaagtattggacgggcagtgaccagtgtgtcagataaagtgctgcttttacaggcagatttcgactggagaagaatcatgacgctggagtcattggatcagtattatcatggagaggattccggccgggtgatccgtaatgcctgtgaaaatgtgtcagtgatgaatgaagcggcgcatcagctggtggttgccaatggattggaagatgtgattattgtcaacacagcagatgcggtctatgtgtcccgaaagagcgaagcggatcagatcaagagcattatccgggagaattacgagaagcagcagtcttattttgatgagggaacagtctattataccccttggggcatcaaagagaccatacattacggggattcctgtaaggtaaagaagatcacgatttttccgggaaaagagctgtccagacatgtgcataagcttcggacagagcattggtctgtgatcagtggagtcgcaaccattcagctggatgaacagatgggtgagtatggatcaggtgaaagtatctctgtgcccatgggaacacctcatcagatcgccaaccggggaacggaagatctcgtagtcattgaagtaagtgtaggtgagctggaatatggtcatggaaatgatctgacccgcctggcaggtcagtctattgtgaagacggactgtgatgagattgttcgcatggagcctgcttttaaggacaatctctggggaggtacccgtctgcgggatgtctacggcaagaaatgcgactatgatattgtagcggagagctgggaattgtccacacataaagccggtcagagtatcgttgctacgggaaaaaataaaggtcttatgctgggcgagtatatcaaccggtttggcagaggtatattaggctggaaatgtgatccttatgagcgatttccgcttctgatcaagtttattgattccagagaaagtctttctattcaggtgcatcctggggatgattatgcactgcagaaggaagacgaatatgggaaaaatgaactgtggtatgtggtggattgtgaaccagagtcttatctgtattgtggattttccagagacacagatgaggcagaggtgcgccgtcggatcgaggatggtacactgacggagatcctgaataagattcctgtaaaaaagggagacagttattttattgaaaatggaacggttcatgccattggaccaggtgtactgatctgtgagatccagcagagttctaatgtgacataccgtctgtatgattaccagagacgcgacaaatacggagaactgcgggaactgcatattgacaaggccatggaggtgacgaatttccatgagaaagatatggaagccgccaagaccatggaatgcaaatacttttcgattgagaaaagcgtgtttgatggagaggtttcctttaatctggatgactccagcttccgtgcctttgtggtactggagggaggcggtcaggtatcctgtggagaggagtcattagtctaccgtccggcggactgcttttttgttcctgcaggcaagaaaaccgttgtttttcatggttgcggaacggtattgaaggttcaggtctaa

SEQ ID NO: 2709 - DNA, 3288 bp, Blautia sp.
atcatcgtgccggagcagtttaccatgcagacgcagaaggatctggtcatgatgcatccgcgtcatggaatcatgaatatagatgtcttaagcttcgagcgtctggcacaccgggtcttttcagaggtgggcggcgagcaccggaagattctggaagatacgggaaagagcctggtgcttcgaaagctggcggaggagaagaaggatgaactgaccctgttgggaggaagcctccgaaagctgggatacatttctgaggtaaagtcactgctgtcagagttcgtgcagtatcggatcgaaccggaagaccttacacagatcatggagcagaataagagtaatcctcagttgtattttaagctgaaggatatgaaggtgatctatgaaagcttccgtcagtatctgaaggacacatatctgacagcagaggagctgttgaaagcgctggaggatacggtggagcagtcacggtcagttcggaacagtgtgatcgttctggatggctaccatggcttcacgcctatccagctggggctgatcggaagattgctgatgcttacggatgaattgtatgtgacgatgacactagatcacagggaagagccatttcagatggaggcggagcaccagctcttctatgctacgaaaaagacgattcaggatttgaaaaaagtagctgaacagacaggcgtggagattcgaaagcccatcatgcttggaaaagataaaatctggcggtataaggatgcaccggcactaagatttctggaggagcatatctaccggcacagcagacggttctggaacgaagaaaccgatgcagtcacattgtttgcagcgaggacacccaggtcagaagtggagtgtatcagcagagagatcctgaaattagtacgggatgagaagttccgctatcgggagatggcagtggtcactggagacctggatacttatggaccattgtttgagcagacctttgcacgattaggaattccgggatttatggatgccaagcgggatgtgctgaagaatccgtttgtggagtttctgcgggcattattgctggcagttcaggaggatttttcttatgaatctatgttccgtctgctgcgaagcggcatgacgccggtggataggcgagagacagatctgctggaaaattatgtaatcgccagaggtatccgtggattctccggctggaaaagggaatggaaatatccactgaagcagatgacagaggaggaactggcagaagtcaatacgcttcgggaaaaggcactgtccggtctggaaccactgcgaaagagtctgaaggataaaaaggcagatgcggaagttatgaccagaagtatctatgaatatctgacggatctgtctgttcaggagcatctgcttcagtatgagcagcagtttgagcaggaaggaaatctgagtctggccaaagagtattcccagatctatggcatggtcatggatctgtttgacaagctggtcatgctgcttggagactgtcaggtctctctggaggagtatgctcagcttctggatgccggattttcagagatgaaggtgggactcattccggcaggtaccgatcaggtggttgtgggagatatggagcgaagccgtctgaaagacattaagatattgttctttgcaggagtcaatgaagggagtgtgcctcgtcagaaagacagcggcggccttctttctgaaatggaccgggagaccttgttatcccagaatgtggagctgtcacccacatcccggcaggagacctgtatccagaaatactatatgtacgtgaatctgacccggccttccatgagacttaaattatcctggagcctggcggatgagggtggtaatgcactgcggccgtcctatctgatccgttcagtgcaggaattgttcctacaggtggctgtggagacagaggcagagcaggagctgttggatcgtctggcttctccggaaggaaatttaagtgatgtgacggaggctttacaggcagccagagaaggaacctatgatgctcagcagaagatgctggccagatggtatgcggagcaggcggactggaatcagaagcttgaccgcctgatggatgcagtcttttacagtcgaaaggaagaacctattggaaaggcagtggcgcggactctgtatggaacccttctggaaggaagtgttaccagactggagcagtttgcagcttgttcgtatgcacatttcctgcagtatggtctgcgtctgaaggagcgggaggaatatggtcttcaggcagtggatatgggaaatgtctttcacgatgcacttaaatatttttcggataagatcgaggccagtgaatatgattggtttcatgtaccagaggagaagcggacggcctggatggaagaggcactggagcatgctcttcagatctgcgcagaaaaaggtctgggagaggaagcaactgatgcctataccatggagcgtatgaagcggatcgggcagcggactgcctgggcattgatggaacagcttcggaaaggtaattttgcaccggagaagacagaagtatctttccgcaatctggagcagcttccaagtgtatcggtattgttgtcagaggatgaacgcatgagacttaagggacggatcgaccgtgtggatatctgcagagagcagggaaatgtatatgtccgagtcattgattataagagtggatcgacccggtttgatctgaccagtgtgtactatggcttgcagctgcagcttgcagtctatctcaatgcggcaatggatatggagagccgggagggtggggaagtccatccggctggtatgttttattatcatattgaagatcctatgctggattatgaagaagaggaagacaccgaacgacggatgctcaaagagctggcattcaacggattggtcaatgcggatcctgaggtggtgaagctgatggataaggaactgcatggttcctccgacattttaccgataaggcttaaaaaggatggaacttacacagcagcatcctccgtggcggaggaacaagagcttcttagactgtcccgtcatgtaaaccgaaagcttacagaatatggacagcggattctggcaggagaggtcagtctggcgccctatgagctgcaggatgacaatgcctgcaggttctgtacatttcacagtgtctgcggatttgaccggcgtctggatggctgcgagaagcgcagactgacaccgttaaataaagatgagatctggagacggcttgaggaggaagaatcatga

SEQ ID NO: 2710 - DNA, 2097 bp, Blautia sp.
gagcagatcacaactctgacgggagtaaggaagttgctatatgtcaaggaaaggatggagagaagtatgagtgtaaatgtggctgaagtatttggtcaggacgtatttaacgaagcagttatgaaagaacgtctgccggaagtgacttacaagcagatggtaaaactgatgaatgagggcggcgaggttacgctggagctggccgacatcgtggcaaaagccatgaaagaatgggcgatcaaaaagggagcaactcattacacacacattttccagccgtacattgtaagtatcggagctgagaaacacgactccttcgcagacattccgaagggtggcaagatcgagaactgcttttccggcaaagacctgatgatgggcgagccggatgcatcttccttcccgtccggcggactccgtgcaacctgtgcagcaagaggttataccgcatgggatgtaggatcaccggcatatgtgaaagacggaatcctctgtattccgactgcattctgttcttacaccggcgagtctctggataccaagactccgctgctcaaagcatgtgatgctgtcagcaaagcaggtgttcgttttgtaaaaatgtttggaaataccgatgctaaaagggtcagctcttatgttggacctgagcaggagtattttattgtaaatcgtgaaaaatatctggagcgtccggacctgatctatgctggacgtactcttttcggagcaccggcaccgaaaggacaggagatggaggaccagtacttcggaccgctgaagaccaagatcgcagatttcatggcagatgtggatgagcagctctggaaactgggtatcactgttaagacccagcacaacgaggtagctcctggacagcatgagattgcaccgatcttcgcaccggctgacgcagcactggacagcaacttcctggtaatggatgtactgaagagcaccgcaaccaagcatggtctggcttgcctccttcatgaaaaaccatttgcaggagtcaatggatccggtaaacacaacaactggtctctgggaaccgacaatggtgtcaacctgttcaaaccgggcaaagaaccgaacaagaatcttcagttcctgtgtgtacttgcctgcctgatggaagcagtcaacaagcatgctcttctgctccgtgcagcggcatccaacactggtaacgatcacagactgggagctaatgaggcaccgccagcaatcatctccatctatatgggcgatcagcttggcgagatcgtagatgccattgtagcaggcgttccgtttgctcagcttccgtgtgcagaggttggaactctggatcttggagtcagcacccttccggtactgccaaaagatccgactgacagaaaccgtacttcaccgtttgccttcaccggcaaccgtttcgagttccgtatggtagcatcttctgtatccatcggtgatgcaaacacggttatgaactccatgatggcagaatccttcaacaaagcatgcgacgctctggaaggagctgaggactttgaaaaagctgcaattgactacatctacaagaccatgaaagagaataagaacattgtcttcaacggtaatggttactctgatgagtgggtagaggaagcagctaagagaggtcttccgaacgtgaagagtatcgtggatgcaatcccggcatacacagatgagagcagcattgagatgttcgaaaaactgggcgttatgacgaagagagagctggaagcccgccgcgagatcaagctggaagagtatgcaggcctgatcaacatcgaggctcgtaccatgatcgacatggctgcaaaactgtacattccgtcagttatcgcttatgtcaacagcgttgcatcttccatgagcaccgttaagagcgcatatgcacaggctgatactaccgcacagcagaccattcttgtaaaagcaagctccctgctggcagatactcagcaagctctcgataacctgaaagcagctaccgatgcagccgagtccgcaaaagacttccatgagaaagtccttccggcaatggcagctcttagaacaccggtcgatgaactggagaccatcgtg

SEQ ID NO: 2711 - DNA, 2016 bp, Blautia sp.
atggcaatcgtgcagatgcagcggatcaatatctgtgcattgaagaagaatcggaaagcgatcctggaacgtctgcaggaactcggagccatggaagtcgatatccggctggaagatgaagaactctgtgagaaacaggatgtaagcagttccagatcgactttcgagagaaggtcccagactgcggaccaggcactccatatactggatgagtatgcaccggagaaaaaaggaatgctggactctttggcgggaaagccgctgattgataaggagtctcttgcaaaagctgctgcgcagcaggacaattttatgcagaccgcaaccaagatcataatgttggataagcaggtggctgagagtcaggcagcagcacagaaactggaaaatcaggcagaaacgcttacaccatggcttggtctgacagttccggtaaacttctcaggaacgagaagtacagcatttctgatcggtacattaccaggacagcaggatcagcagagtgtgctgaagattcttgcagacgcagcaccggagatcgaggcagtaaatgtcgaactgatatccaaagataaggattttacttatctggctgttgtatgtctcagacaggatgcatccaaagtggaggaagcacttcggacggcgggatttgcaaagccgtcatcagccgtttctaagataccggcacagtacaaggaagagcttctgacagagatgaaagaagcgcaaagcaaagcagaggagctggggcgtgagatcgcctcttatgctgcaagcaggcaggatctggagctgatctcagattactatcagacaagagccgaaaaatatcggattcttggagagcttcctcagacaaagagtacatttgcggtaagcggctatgttccggcacagaaagcagaggcaatcgtcaaagagctgaccgacagatatggtgcggcagcagaagcagaagagatcgcagaggatgaagaagctccggtcctgcttcataacaatcggttttccgagtctgtggagggtgtgcttgcatccttaggtcttcctgcaaaaggagagatcgaccccacgttctttacatcgattttttatgtatttttattcggactgatgttgtccgatgcagcttatggattgatcgtttcgctggtatgcggaatcgttcttctgaaattcccgcggatcgaggagaatttaagaaaatccattcagttattcttctggtgtggtatttccacattggtatggggcatactgttcggcggttattttggagacgcgctggatgtcatatcggagaccttctttggtcacaagatatcgatcccggcattgtggttcgtaccgttgaatgagcccatgagaatgcttctgtattccatgctgttcggtgtgatccatctgttcaccggacttgcattaaagggatatatgtgtatcagagatcacaaatatatggattttatctgtgacgttgtattctggtacatgctgcttcttggactgatcggtattctgatcccgtccagcatgtttgcaggcattgcaggaaaacagatcgtattcccggcagctctcaatgcagcagcaaaatggagcgcaatcctgggtgcagttggaatcgtactgttctccggccgttccagcaagaatccggctcttcgcattgcactgggtgcttatgacctgtacaacattacaggctggctcagtgatgtactttcctactcccgtctgctggcacttggccttgcaaccggagttatcgcttccgtagtcaaccagatgggaagcatgggcggaaagagcatcggaggagtgattctctttatcgttgtatttgtgatcggtcatacattcaatatggcgatcaaccttctgggtgcgtatgtacacacctgcagactccaatatgtggagttctttggaaaattttacgaaggcggtggacaaccgttccagccgtttaaattgaaaaccaaatatgtggatatcaaggaggaaaaataa

SEQ ID NO: 2712 - DNA, 1917 bp, Blautia sp.
atgagtacagaatacggagcagatcagattcagatattggaaggacttgaggcggtcagaaaaagacctggtatgtatattgatgatacttccttccggggactgcaccatctggtgtatgagatcgtagataattccattgatgaggcactggctggatattgcactcatatccaggtcacgatccacaaggataattctatcactgtggaagatgatggacgtggaattccgacaggcatcaaccataaagctggaaaacctgcagttgaggtggtatttactgttcttcatgcgggaggaaaattcggcggtggaggatacaaagtatccggaggacttcatggcgttggagcatctgttgtaaatgcactgtctgactggctggaagttacaatttacagtgaaggtaagatctatcgtcagagatatgagagaggaaaagtgtgctatccgctggaagtagttggaacctgtctgccaagcaagactggtacatctgtaagcttcctgcctgataagaccatgtttgaagtgacagagtatgatttcaagactctgcagaccagactgcgcgagatggcatttttgacaaagggactgaagatcacgctgacagatgagcgtgaggatccggtgcgttccaaaatctatcattatgagggcggtattcaggaatttgttcagtatctgaataagagcaccactccactgtatgacgatattatttattgtgaagggataagagatggtgtgcaggtggaggttgcattccagcataatgattcttattctgagaattgttatagttttgtaaataacatcaatacccatgaaggcggtacccatctggccggctttaaaaatgcaattactaagacatttaatgattatgcaagaaagaataaactgctcaaagacagtgagaacaatctgtccggtgatgatatccgtgagggattgactgctatcatcagtgtcaagatcagtgagccacagttcggtggtcagacaaaacacagtcttggaaacacagaagcaagagctgcagtagatggagtggtcagtgaacgtctgacagtttacctggagcagaatccacaggtagctaagctgattcttgaaaaatccattctggcacagcgtgcaagagaagcagcaagaaaagcaagagaactgaccagaagaaaatctgctctggatggatttgcattgcccggaaaactggcagactgttcagacaaagatccgtcaaaatgtgagatctacatcgtagagggagattctgcaggcggttctgcaaagacggcgcgtaaccgtataacgcaggcaatccttccacttcgtggtaagattctcaatgtagaaaaagcaagactggatcgtatttacggaaatgaagaaatcaaatctatgatcactgcatttggtactggtattcatgaagattttgatatcagtaaacttcggtatcacaagatcattatcatgaccgatgccgatgtggatggtgcccatatcagtacattactgttgacgttcctgtatcgttttatgccggaactgatcaaacagggatatgtatacctggcgcagccacctctgtacaaagtagagaaaaataaaaaagtatggtatgcatacagtgacgaagaattgaataacatccttaccgagatcggccgtgatcagaataataagatccagcgttataaaggtcttggagagatggatgcggagcagttgtgggagaccactatggatccggaaaaacgaattcttctgaaagtaaccatgaacgaagaagaatcttcagagatcgacctgacattcaccacattgatgggcgataaggtagaaccgcgtaaggagttcatcgaagcgaacgcaaaatatgtgaagaatctggatatttaa

SEQ ID NO: 2713 - DNA, 2751 bp, Blautia sp.
atgggggcattggaaatcatgccaaacaagcatatcagagtttatgaactcgcaaaggaactgaacaaaacaagcaaagaaatcatggccgtactggcagagaagaatattgaggtgacaacacatatggcaacacttgaagataatcaggcagaactggtgcgcggagcagtaggttccgggcagcaggaagctaaaaaagaaggagcagctccggcaaagaagaaaaaattcgtagtggtacacaatccggagaacagcagagacaagaagagtccggagcgtcgtccgcagactcagaaaagcgcagcaaaacctgcggcaagaccggcagcggcaagaccggcagcggcaaagccggcaacagcaccagctggagcaacagcgtccgcaggaacaacggcagcacctgcagcatcaacagcagcaccgaaacgcgaaggcgcagcagcacctgcagcaagacctgcaagaccggcagctgatcgtcctgcaaatggtgagcgcagaagttatggcgaccgtccgcagggtaaccgtgatggacagggacgcggagacagaccgggatataacagaggcgaccgtccgcagggcaaccgtgacggacagggacgcggagacagaccagcatacaacagaggcgaccgtccgcagggtaaccgtgatggacagggacgtggagacagaccgggatacaaccgtgacggacagggacgtggtggagatcgtccgggatataacagaggcgaccgtccgcagaatggtggacgtgacagccgtggaggacagggcgcaagaggtggtgcaggccgtcagatgaaccgttccttcgatacaccggtggagaccaaaccggaaaacagaagatacgataaccgtaatcatcagaagcaggaaaagcagtacaaagatgaggatatcagcaagctgaagaacaaaccgggacggttcatcaaaccggaaccgcagccggtagtgaagaaggattcatccgaaccgaagaaactgcagcttccggagatgatcagcatctctgatctggcagaccgcatgaagatccagccgtctgcgatcattaagaagctgttcctggaaggaaagatgctgactgtgaactctgagctggacttcgaggcagcaggagagatcgcactggaatataattttgatccggaaccggaagtaaaagaggatgtaatcggaaagcttctggaggatacggaagatccggaagacactctggtacagagagcaccggtcgtatgtgttatgggtcatgtagaccatggtaagacctctcttctggatgcgatccgccatacaaatgtaacagaccgtgaggctggcggtattacccagcacattggtgcatatatggtaacggtatctggcagaaagatcacattcctggatactccgggacatgaagcattcacagctatgcgtatgagaggtgctaattctaccgatattgcaatccttgtagttgcagcagacgacggtgtgaaaccgcagactgtcgaagcgatcaatcatgcgaaagcggccggtgtagaggtgattgttgcgatcaacaagatcgataagccaggtgcaaatattgaacgtgtaaaacaggaactgactgagtatggtctgatcgcagaggactggggcggaaacaccatctgtgtaccggtatctgcaaaatccagagagggtattgaagatcttctggaaatggttcttctgactgcagatgttctggagctgaaggcaaatccgaagcgtcaggcaagaggtctggtcatcgaggcggagcttgataaaggaaaaggaccggttgcaaccgttctggtacagaaaggtacgctgcacgtcggagatttcatcgcagcaggatcttcttatggtaaagtccgtgcgatgatggatgataagggacgtcgtgtgaaagaggcaggtccgtccactccggttgagattcttggtcttaacgatgtgcctatggcaggtgagatcttcatttctccggaaagtgacaaagaggctaagacattcgccgagacctttatcaaagagagccgtgagaagatgctggaggataccaagcttcgtatgtctctggacgatctgtattcccagatccagtctggaaacttaaaagaactgaacctgatcatcaaagccgatgtggctggttctgtagaggctgtaaagcagtccctgcttaagctctccaatgaagaagtcgttgtaaaatgtatccacggtggtgttggtgccatcaatgagtctgatgtgactctggcaagtgcatcttcagcaatcatcatcggatttaacgtaaaaatggatgcaacagcaaaagaaactgcggacagagaaaaagtagatgttcgtctgtaccgtgtcatttatagtgcaattgaagatgtagagcgtgctatgaagggtatgctggatccggtatttgaggagaaagttatcggtcatgcagagattcgtcagatcttcaaggcttccggcgtaggaaatatcgcaggttcttatgtgcttgacggtatgttccagcgtggatgcaaggttcgtatttctcgtgaaggaaaacagatctacgagggcgagctggcttccctgaagcgtttcaaggacgatgtgaaggaagtaaaagccggatttgaatgtggtcttgtatttgacaagttcaacgagatccaggagcttgatatggtagaagcctacatcatggtagaggtgccaagatag

SEQ ID NO: 2714 - DNA, 2145 bp, Blautia sp.
atgaagaaatctagagcagttgttaccatgcttctgacggttgtcctgaccggtcttctgttgttcacttcagcagcaggctggggagcagacggactgggttctgcagataagatccatctgggtctggatctggcaggcggtgtgagcatcacctaccaggcagttggcgatgaagcaccaagtgcagaagatatggcagacacgatctacaagctgcagaagcgtgtggaaaattacagtaccgaggctgaggtttatcaggaaggtgctgaccggatcaatatcgagatcccgggtgtgaccgatgcaaatgcaattctggaagagcttggaaaaccaggttctctgcagttccagaccacagatggtgaagtggtactggaaggaactgatgtggccgaggcgcaggcaggttccaccacagacagttatcagaatcgtcagtatgtggtagaactggtgctgacggatgaaggtgcacagaaatttgctgaggcaacttctgcaaatattggaaagcagatcgcaattgtctatgatggaagcgtgatcagtgctccgactgtccagaatgcaattactgatggaagatgtcagatcaccggtaactttacatacgagcaggctgatcagcttgcatccaccatccgtatcggttctttgtccctggaacttcaggagctgcggtccaacgtggtaggtgctaagctgggtagcgaagcaatctccactagccttgtggcaggtgctatcggattcgctattgtagttgtcctgatgatcattctgtaccgtatcatgggtctggctgcaggtattgcgcttacttcctatataggtattgtactggtacttctgaatatttttgagatgactctgaccctgccgggtattgcaggtatcgttctgtctatcggtatggccgtggatgccaacgttatcatcttctcccgtatccgcgaggagatcgcaaccggcaagactgtgaagtcttccattaagatcggattccagaaagcgctgtctgctattgtggatggtaacgtgacgactctgatcgccgctattgtgcttggattcaagggatccggaagtgtcaaaggttttgcacagactctggcacttggtattatcgtatccatgttcaccgcactggtcgtgaccagacaggtactgaatgcgctgtatgcactgggactgcaggatgagaagtggtacggtacagtcaaagagagagcaccgatcaacttccttggcaagagaaaagtattctttacagcttcgctggcagtgatcgtggcaggacttatttatatgggaatcaatgccggatccggaaaaggaatcctggcatacagcctggaattccagggaggaactgcaacaactgttgaattcaatgaagatatgtctattgctgacattgatgaaaaagtcgttccggtagtatccgcagtgactggtgataatgatattcagacccagaaggttgcaggaactaatcaggttattatcaagaccaaggagttgagtctggatcagagacaggagctggataacagtctgacagaaacttttgagctgggagatacggcaatcacagcagagagtatcagcggtgccatcagccaggaagtaaagcatgatgcagtcgtatctgtaatcattgcgacgatctgtatgctgatctatatctgggttcgtttcaaggatatccgttttgcaaccagtgcagtagctgctctggtgcatgatgtactggttgttctggtattctatggagctgcaagaatttccgtaggaaatacctttatcgcatgtatgctgacgattgtcggctactccatcaatgcaaccatcgttatcttcgaccgtatccgtgagaatcttacagatatgaagaagaaagatactctggaggatgtggttaatgcaagtatcacacagacccttaccagaagtatctatacttccctgactactttcgttatggtagcagtgctgttcatcctgggtgttgcatccatccgtgaatttgcacttccactgatggttggtatcgtgtgcggtgcctactcttccgtatgcattaccggtgccctgtggtatgtaatgcgtacaaaactgggtgagaaaaaataa

SEQ ID NO: 2715 - DNA, 2343 bp, Blautia sp.
atgaacaagaaggaactgacctggcgtatccgagtatatggcatcgttcagggggttggttttcggccaacggtgagtcgtcatgcgacatccaacggaatttgcggaacggtctgcaataagggaccttatgtggaaatatatgctcaggggcaaaagaaacagatggaaggattcctgaaggcactggaagtccaaccacccaaacgtgcagctattttaaaaatcaatacagaggatgttacagcagagacagacatgcattttgagacgtttgatattattgaaagtgaaaagaccaagggagagatctttgtttcgccggatattgcgatctgcgaagaatgtaaggaagaaatgtacgatccaaaggacaggcgatatctgcatccatttatcaactgtacctgctgtggaccaagacttaccattctggatacgctgccctatgaccgggaacggacgagcatgaaagaatttcctatgtgcccggactgtgcagaggaatatgaggatgaaacgacaaggcgctatgatgcgcagccggtgtgctgtaataaatgtgggccggaagtttatctgatcggcagatcagagcgaggacgggatgctatcacttatacacgtcggatgatcagcgaaggcaagattgtggcaatcaaaggaatcggcggtttccatctgtgctgtgatgccaccaatgaagaagcagtccagcgtctgcggacattaaagagacgtccggccaagccttttgcagttatggcaaaggatgaatcggtggtaaagcgggaatgtgtggtgacaccaaagcaggagatgatcctgaccggccatcagaaaccgatccttctgctggataaagaaaatggaggcagactggcgccttctattgcaccgggcaatccaaaagttggagtgatgcttccatatgcacctgtgcaattattaatttttcagtatgatgacgggatcaagatgccggatattctggtcatgacaagtggaaatacttccggcgcaccgatctgccgcgaggatacggaggcagttgcggagctgtcacatctgtgcgatgccatgctgtcccataatcgaaagatcaggatccgggcagatgatacggtcatggacttttacaaaaatgaaccgtacatgatccgacgttccagaggttatgcaccgcttccatttatgatgtcgacagactggaaagggaaggtgctcgcagtcggcggagagttgaagaataccttttgtattggtgtggacagtcggttttatccgtctccatatgtgggagacctggaagacttaaggacagtaaaagcactgcaggagacgatccaacggtttcagacactgttggaagtacatccacaggtggtagtctgtgatctgcatccgaaatataattccacagtggtggcagaagagctgggttatccgatagtaaaggtgcagcaccattatgcacatattttatcctgtatggtagaaaatgactgtcaggagccggtcattggagttgcctttgacggaaccggatatggaacagatggtacgatctggggtggagagattctgctggcagattatgaggactttaccagatttggaaatataactccatttttacagattggcggagatgtttctgcaaaagaaggctggcggatcgcagtatctatgatctacggctataccaaagactgtgagcttgcaggggagattatgaaaaagcttgatctgtgcagtgagaaagagatcaaggtacagtttgccatggcagacaggaagttgaatgcagtgctctctaccagtgtgggacggttatttgatgcagtcagtgcaattcttggtatcagacataagtccagctttgaaggcgaggcatccatggcactggaatttgcagcagaagcatatgagcaaaaagatcatgaacagaaacaaaatgagaaaatagatccgttggtatatgaagaagacggacatgttattctgaatacccaattgttggtgcagcggattgtggaagcaaagctgcagggggcagatagtggcagactggcgtattggtttcatgagatactggcagagcagatcacagctgtctgtgtggaagctcgaaatgtaagcggcaggcagaaagctgtcttaagcggtggcgtgtttcagaatcgcctgttgttgcgtctgacagaagaacggttgacagaagaaggatttgaagtgctgcggcaccgtatggttccgccaaatgacggaggaatcgctgtcggacaggcggcatatggtatggcacaactattcagagctatgcacatgggctctgaatag

SEQ ID NO: 2716 - DNA, 2139 bp, Blautia sp.
atggctttaaagattgcacttgccggtaatccgaactgtggtaaaaccactctgttcaatgcactgaccggcgcaaatcagttcgttggtaactggcctggtgttacggttgagaaaaaagaaggaaaattaaagggacattctgatgtagtgatcatggaccttccaggaatctactccctgtctccatatactttggaggaggttgtagccagaggatatctggtatctgagcgtccggatgcgatcctgaacattatagacggaactaaccttgagagaaacctgtatctgtccacacagctgctggagcttggaatcccggttgtcatggcgatcaacatgatggacgttgttaagaaaaacggcgaccagatcttcattgacaaactcagcgaagtacttggatgcaaggttgttgagatctccgcactgaaaggtactggagtaaaagaggctgctgaagcggcagttcaggctgcacaggctaacaaagcacagcagatcgtacatacctttgataaaaaagttgaagaggctctgactgcaatcgaggctaagatcggcagcgaggttacagaagaacagaagcgtttcttcgctatcaaactgtttgagcgcgatgacaagatcaaagagcagatgaagagtgctccagatgttgacagtattgtagatggcgtagagaaagccatggatgatgacgcagagagtattattaccaatgagcgttatgtatacatttcttctattattggaaaatgctgcaagaaagcaaaagcaggacagatgaccacatctgataagatcgaccggatcgttaccaatcgtatctttgctcttccgatttttgcagtgatcatgtggttggtatattatgtgtctgtaacgacggttggtacttttgtaacagagtggaccaatgaggtactgtttggagagatcgtacctcctgcagtagaaggattcctgaccagcgttggttgtgctggatggctgcagagtctgatccttgatggtattgttgccggtgtcggagctgtccttggattcgtaccgcagatgctggtactgttcatcttcctggctatccttgaggactgtggctacatggctcgtgttgcatttatcatggatcgtatcttccgtaaatttggcctgtccggtaaatccttcatcccgatgctgatcggtacaggatgcggcgttcctggtgttatggcttccagaaccatcgagaacgagcgtgaccgtcgtatgaccatcatgacaacaacatttattccttgtggagctaagcttccgatcatcgctctgttcgcaggtgctatctttggcggtgctccgtgggttgcaccaagtgcatattttgttggtatcgcagcaattatctgctccggtatcatcctgaagaaaaccaagatgtttgctggtgatccggctccgttcgttatggagcttccggcttatcatatgccgacagttctcaatgtattgagaagcatgtgggagcgtggctggtcctttattaagaaagctggtacggttattcttttatccaccatctttatctggtatacttctacttatggatttgagaatggaacctactgtgcagtagaggatttcgcagacagcttccttggaacgattggtaatgcgatctcctggatcttcattccgcagggattcggcaatgcaaaagctactgtagcagcaattaccggtctggtagcaaaagagaacgtagtaggtaccttcggcattctgtatggattagaggaagttgctgaggatggtgcagagttctggggcagtattgccaaggattatactgcagttgcagcatatgcatacctgatatttaatctgctgtgtgcaccatgcttcgcagcgatcggagctatcaagagagagatgaacaatgcaaaatggacctggtttgcaattggatatcagtgtctgcttgcttactgcgtatctctggtgatcaatcaggttggaagcgctatcttctatggtgtatacactccatggctgatcgttgcaattgcactgatcgtactgttcatctggctgttggttcgtccatataaagaagcaacaactctgaatgtaaaagtaaaggcaagggcataa

SEQ ID NO: 2717 - DNA, 2217 bp, Blautia sp.
atgagtgatctggaattattgaatcgagagcagcaggaagcggtgctgcatgtggatggaccgcttctgatcctggcgggagccggatctggcaagacgagagtactcacctatcggatcgctcatctgatcgatgaatgcggagtgaatccgtggaatattctggctatcacatttactaataaggcggccggagagatgcgggaacgcgtggataagatcgtgggatatggttcggagagcatctgggtcagcacattccattctacttgtgtgcggatcctgcgccggtatattgaccggctggggtatgatacgaattttactatttatgatacggaagatcagaagacggtgatgaaaagcgtctgtcagaagctacagctggattcgaaactctataaggaacgcatgcttctgaatgtgatctctcatgccaaagacgaatatatttcacccaatgagtttttgctggaggcgaaaggcgatttccgccaggagaagattgcgcaggcttatgtggagtatcagaaggaattgaagaaaaataatgcgctggattttgatgacttgctggtgaagacggtggagctgttccagagctgcccggatgtgctggaatactatcagaaccgttttcgttacatcatggtggacgagtatcaggacaccaataccgtgcagttcaaatttatcagtacgctggctcgtcagtaccgtaatctgtgtgtagtcggtgatgatgatcagtctatttacaagtttcgtggcgccaatatccgcaatattctggattttgagaaagtatttccagatgcaaaggtggtaaagctggagcagaattatcgttccacacagaatatcctgaatgcagccaatggcgtgatcgccaataacagagggcgtaaggagaaggtactctggacggagaatgaacagggtgagccaatcctgttccagcagttccagaatggctatgaggaagcggaatatgtgtccggggagatcagtaaaaaggtgcggaaaggggaagcagaatatcaggattttgcagttctttaccgcaccaatgcccagtcccgcctctttgaggagaagttcctgtatgccaacattccatacaagatcgttggaggtgtgaatttttattccagaaaagagatcaaggatattctggcatatctgaagaccatcgataatggaaaggatgatctggcagtccgcagaattatcaatgttcccaagcgggggattggaaatgtaacacttgcaaaagtacaggcctatgctgattccagagatatcagcttctttgaagcactggaagaggcaggtgagattccgggtcttggaaaagcggcattgaagatccagccctttgtgcatctgatccatgagatgcgtctgtcactggcagatatgagtatgcaggatctgatccaggcaatccttgataagaccggatatgcagaagacctgaaaaatgaagataccgacgagtctgaggcgagactggaaaatattgacgagttcatcaataaagcagttacctacgaagaaggagctgaagaaccgaatctaagtggattcctggaagaagtagctcttgtggcagatattgacagtgtggaagatggagacaaccgtgtgctgcttatgacgcttcatagtgctaagggtctggagtttccatatgtatatctggctggtatggaggatggattgttcccaagctatatgtccattgcagcagatgatcccaccgaggagatcgaagaggagcggcgtctgtgttatgtggggatcacccgtgccatgaaggaactgaccatcacctgcgcccgctgccgaatggtacgcggagagacccagtataataatgtgtcccgatttgtgcgtgagatccccccagagctgctggcgcgtaagagtgtgatgccaagagaaccaaagaagccggaagtgccgcagaatacatcttatcagaaagcaaaggaagcgttccggacaaagacgtttgatccgcagcagttcaaagtggtgaaagcggataagttggactatactgtgggtgatcaggtgtctcatgtaaaattcggaaaaggaaccgtgctggagatcactgagggcggaagagactatgaagtcaaagtggattttgaacggttcggtgtgaaaaaaatgttcgcatcctttgcaaaattgaagaaggtatga

SEQ ID NO: 2718 - DNA, 2127 bp, Blautia sp.
gtggtgattgatatgacggaagaacaggcaagagaagtgcaggaggatgatagaagtatcgttaagatggaagattttaccagccctgatgaattatatcaggaactggtgcagcgcgtgaccaaatatcatccatctgcggacatctccatgatcgaaaaagcataccaggtggcaaagaaggctcatgacggacaagtgcgtaaatccggtgagccgtatatcattcacccgctttgtgtggcaattattctggcagatctggagcttgataaggaaagtattgcagcaggtcttcttcatgatgtggtagaggatacaccgatgactacagaagatctggcaaaggaatttggtgatgaggtggcactgctggtagatggagtcaccaagctgggtcagctgagctattctgccgataaagtggatgaacaggcagagaacctgagaaaaatgttccttgcaatggcaaaagatatccgcgttatcctcatcaagctggcggaccggcttcacaatatgcgtactctgaaatacatgaagccggaaaagcagaaggaaaaagcacgagagaccatggacatctatgcgcccattgcacagcgtctcggtatttccaaagtaaagatcgagctggatgatctggcactgaaatatctggagccggatgtctattatgatctggtatcccagatcgcagagaagaagagtacccgtgagaaatatgtacagtccatcgtggcggaagtcaaacagcatatggacaatgccaagatcgaggcagatgtacagggaagagtgaaacatttcttcagcatttataaaaagatggtcaaccaggataagacgctggatcagatctatgatctgtttgctgtacgtattctggtggaatctgtcaaagactgttatgcggcactgggtgtgatccatgagatgtataagcctattccgggacgtttcaaagattatattgccatgcccaaagccaatatgtaccagtctttgcatactacgctgattggtccgaagggacagccttttgagatccagatccgtacttatgagatgcaccgtactgcagagtatggtattgctgcccactggaaatacaaggagagcggcggaagcaatgagcagaacgttgaaggtaagaacagcgcggaggcaaagcttacctggctccggcagatcctggagtggcagcgtgacatgtccgataaccgggaattcatgagtctcttaaagagtgatctggatctgttctccgagagtgtatactgctttacaccaggtggcgatgtgaagacactgcccaatggctccaatacgattgactttgcatatagtatccacagtgcggtcggcaacaagatgattggtgccagagtcaacggaaagctggtgcctatcgagacggtgatcaagaatggtgaccggatcgagatcattacatcccagaactccaaaggacccagccgtgactggctcaacaccgttaagagtacgcaggcaaaaaataagatcaaccagtggttcaagacagagttcaaggaaagcaatattacaaaaggaaaagaactgatcgcccagtattgtaagatgaagggcattcctgccgctcaggtggtaaagccggagtatcaggaaagtgttcttagaaaatatggattccgcgactgggaatctgtactggcagccatcggacatggcggactgaaagaaggtcaggtcgtcaacaagatggtggaagagtatgagaaggcaaagaagaaagaagtgaccgatgccaagatcatggagagcatgaaggaggcaaaggagcagaagcttcatgtgaccaaatccaagagcggcattattgtaaaaggtatcgatgatgtggcagtgcggttttcaaagtgttgtaatccggttccgggtgatgagatcgtgggctttgtgaccaggggaagaggtgtaacgattcaccggaccgactgcgtcaatatgctccatctggcggaatcagagagagaacggctgatcgatgcagaatggcagggaggtgcacagaccagaagcagtgagaaatattcgacggagatcaagatctacggcaacaaccgtaccggccttctggtggat

SEQ ID NO: 2719 - DNA, 2388 bp, Blautia sp.
gtgtatgttaacatacacacgccagacccctcaggtggtacggctcttttagataaagaaggaggatggcagatggagacaacagaatacaggattcctgcggtggcactgcgtggaatggttgttctgccggagatggttacgcattttgacgtgagcagatccagatcgatcaaggctgtggagcaggcattgtctcagaagcagaatctgtttgtggtgacacagcaagatccggatacagatgcgccggagcaggaggatctgtttacatacggaacggtcgtggagatcaagcagatcgtgaagatgccgcacaatatattacgggtactggtggaaggtatgttccgggccagactggtggaacttgagactggtgagtatctgaatgctcaggtggaggagtcggagccggaagattttggcgatctgccgttggttggaaaggaagccatgcttcgcaatctgaaggagatctttcagaactactgcgaaggagccagcagaaacagtaaggaactggtgcgtcaggtgctggacagcagaaccctggaggatatgatcacacaggttatggtacatgcgccctttgactgggagaagcagcagcgtctgctggaggcacagagcctgtccgcatgctacgagatgctgtgcatcaccctgaataatgagattgagatcgaacgatatcgccgaagcgtgcaggaaaaggtaaaagcgcgggtagataagcagcagaaggaatattatctgcgggagcagatgaaggtgatccgggaggaactgggcgatgatggcccgaatacagaagcggaggcgttccgtgaagcggtagagaagctggaagcttctgatgaagtgaaggagcggatcgagaaagagatccagagatttctgaatgcaggctttaattctgcagaggcatcggtgagccgcggctatattgagaccctgctggatcttccgtgggacaagagaggcgaagacaggctggatctgaaagtggcggaagatattctggaaaaggagcactatggactggaaaaagtcaaagagcgtattctggaatttctggcagtccgcaagatgctggatgccagtgagagtccgatcctctgtctggtgggaccgcctggaactggtaagacatctgtagcccgttctattgcagaagcattgaataagaaatacgtacgtatatgtctgggtggcgttcatgatgaggcggagatccgcggacaccgcagaacctatatcggagccatgccgggacgtatcgtggatggcatccgtcaggcaggtgtgaagaacccgctgatggtgctggacgagatcgacaaggtcagcgcagattataagggagacaccttctcagcacttttggaggtgctggacagcgagcagaacagcaaattccgggatcattatgtggagattcccatggatctgtcagaagtgatgtttatctgtacagcaaatgatctgagcaccgtaccgagaccgctgcttgaccgtatggagatcatcgaggtcagtggttatactgaaaatgaaaaataccacatcgctacggagcatctgatgcagaagcagatgaagaagcatggactggatgaaagcagatttcagatcagtgagaaggcgatgcagaagatcatccatgagtataccagagaatccggtgtacgtgcactggagagacggatcgcatccctgtgcagaaaagcagaccgggagattctggagaagaaccggaagaaggttcagatcacggagcgtaatctggagaaatatctgggaaaaagcatctatgagaccaatatgaaggctgagcgcgatgaggtggggattgtccgcggtctggcatggaccagcgtaggcggagatacactggagatcgaagtgaaccttatgccgggtaaaggaaaatttgaactgaccggacagcttggagatgttatgcaggagtctgctaaggcgggaatcagctacatccgttccgtcagcgatgactatgagctggatccggagtatttccagcagcatgacatccacatccatattccggaaggcgcagtgccgaaggatggtccgtcagcaggaatcaccatggcaacagccatgttgtctgcagtgttaaataagccggtgcgggcagatgtggctatgaccggagagatcactctccgtggacgggtattgcccatcggcggcctgaaggagaagcttctggcagcgaaaggggctggcatgaagactgttattgtaccggagaaaaaccgccgtgatgtggaagagctgtccagagagatcaccggcggactggaactggtctatgcacagaatatgaatgatgtaatctcgcatgcatttgtgcagtaa

SEQ ID NO: 2720 - DNA, 2289 bp, Blautia sp.
atggtacaattatatgatggaggcgcatatgtattaaacggaactgagatcattccggatacagcagatgcggcaaagatcctggcagggaagatgggagctgttccttctagagaagaagcaaaaaaacagaccatcgcatatgggattctgagatcccacaatatatctgacaacatggaaaaactgaagatccgctttgataagctgacttctcatgatattacatttgtaggaatcattcagacagcccgtgcttcaggactgaccagattccccatgccttatgtactgaccaactgtcataacagtctgtgtgcagtgggtggaaccatcaatgaagatgaccacatgtttggactgacctgtgcaaaaaaatatggtggagtctatgtgccgcctcatcaggcagtcatccatcagtttgccagagagatgctcgcaggcggtggtaagatgatccttggctctgacagccacacccgttatggagctcttggaaccatggctatgggagagggaggaccggagctggtaaaacagcttctgaaccagacttatgatattcctatgccgggcgtagtaggtgtctacctgactggagcacccacgaagggtgttggcccgcaggatgtggcacttgccattatcaaagcggtatttgccaacggctatgtgaataataaggtcatggaatttatcggagacggcgtaaagaacttaagtgcagacttccgtattggtatcgatgttatgactacggagactacttgtctgtcctctatctggaagacagatgagaagatccaggagttctacgagatccatggaagaagtgaggattatgcagagctgaatccgggcgcagtggcatattatgatggtatgatccttgtggatctggcaaaaattaagcccatgatcgccatgccgttccatccaagcaatgcgtataccattgaagaactgaatggaaatcttatggacattctggatgactgtgagaaacgtgcccatgtgagccttggagatcaggtggcattttctctgaaggataaagttcataatggaaaattatatgtggatcagggaatcattgcaggctgtgcaggcggcggatttgaaaatatctgcgcagctgctgatattctgaagggcagaagcatcggatctgatgaatttactttaagtgtctatcctgcttctatgccggtctatatggaactgatcaaaaatggttctgcggctatgctcatggagaccggagcagtcttaaagacagcattctgtggtccttgcttcggtgcaggggatactccgtccaataatggattcagtatccgccattctaccagaaacttcccgaaccgggaaggttccaagcttcagaatggacagatcgcatcagtggcactgatggatgccagatccatcgcagcaaccgcagccaataaaggttatctgacggcagcaacggatctggatgtggaattccgtaatccgaaatatttcttcgacagcaagatctacgagaatcgcgtatttgacagccacggtgtggcagatccgagtgtggagatccattttggcccgaatatcaaggactggccggccatgagcgcactgccggagaatctggttctgaaagtggtatctgagatccatgatccggtaaccaccacagatgagctgatcccgtctggagagacctcttcctatcgttccaatccactgggactggcagagttcaccttgtctcgtaaagatccggcttatgtaggaagagcaaaagagattcagaaagcacagaaggcgattgaggcaggaacctgcccgttggaagctgtggaagaactgaaaccggtcatggatgcgatccatacggtatatccagaagctggaaaaggtaatctgggagtaggaagcacgatctttgcggtgaagccaggtgacggttcagccagagagcaggccgcttcctgccagaaagtgctgggaggctgggcaaatattgccaatagctatgcgaccaagcgttatcgctccaatctgatcaactggggtatgcttccattcctgatcgatgaaggtgaacttccatttaccaatggtgattatctgtttgtaccgggaatcgcagatctggtaaaacatgcggcatctaagatcaaagcctatgtagtaaaagacggaggcttaaaagaatttacgctgaagttaggtgagatgacagaggaagaacgccagatcatcctgaaaggctgcctgatcaattataaccgggtataa

SEQ ID NO: 2721 - DNA, 2499 bp, Blautia sp.
atgagagaagaatcaacagcaccatcctgcattcaggtgcggggtgcgaaggtgcacaatctgaaaaatatagatgtggatgttccactgaacaagatcgtgggaatcgcgggtgtctccggctctggaaaatcttcgctggctctgggtgtgctctatgcggagggttccagacgatatctggaatctctgtccacgtataccagaaggagaatgactggtgctgcaaaggcgcaggtagatgaggtgctgcatgttccggcagcactggcacttcaccagagaccgggggtgccgggaatccgcagtacatttggaacaggaacagaacttctgaacagtctgcggctgatgtattccagacttgccagtcatcgctgtcccaatggtcattatctgaaaccaactcttgctgtggcggctggttctgagctgatctgcccggaatgtggagcgcatttttatgcaccgtccgcggaggaactggcattcaactcccagggggcctgtaagcggtgtggaggtacgggaagtgtgaggacagtggatcttgatacactggtgccggatgatacattgtcgattgatgatggggcggtggctccctggaacagtctcatgtggtcgttgatgacggatgtgtgccgggagatgggagttcggaccgatattccatttaaggatctgacagatcaggaaaaagagatcgtgtatcatggtccggcagagaaaaagcatattttttataaagcaaagaagagtaaccaggcaggagaactggattttacttattataatgcagtctatacggttgaaaatgccctcgcaaaggtaaaagatgaaaagggcatgaaacgtgtggaaaaattcctgaaggaagagacttgcccagaatgtgacggaagtcggttatctgatcgggcacgggcaccaaagcttcggggaatcagtctggatgaagcctgccggatgacgcttggtgaactggtggaatgggtggcaggtgtgccggaatctctgccggaggagatgcatcccatggcagagcgtatctgtgaatcctttcagtcagcagcaaggagactgatggatctgggactttcttatctgtcccttaaccgggcggcatcaactctgtctaccggagagcggcagagaatgcagttggcaagagccgtaagaaaccgtacgacaggagtattgtatgtgctggatgagccatcgattggtctgcatccatcgaatattgtgggattgaatgcggtgatgcatgatctgattgcagatggcaattctgtacttctggtagaccatgacacgcagattctcaaggagtctgactggatcattgagatgggaccagaagcaggtgcaggcggcgggcatgtgatcgcgcagggaaccatccctgagattgcagagaataaagcatccatgataggaccattcctgtcgggaaaggcagatgcaaagatgcgaaaacagaccgcagagcaggaactgttttcaatgggaatcattcatctgtctacggagtcaattcatacggtaaagccactggaggtggatattcccaaaggacggctgaccgttgtgacaggtgtatcaggttctggtaagacgacaatggttctggaaagtctggtaccgggactgcaggcggtgaccagtggaggaaagttaccggcttatgtgaaagcgattcaggcggaaggcatttctcatgtgaagcttatagatgccacacccattggaatcaatgttcgttccacagtagcaacttatgctaatgtacacgatgaactgaggaaggtctatgccagaacagccgatgcgaaaaatgccggttataaggcaggtgatttctcctataataccggagcattacgttgcccggtctgcgacggaaccggcgagatcagtctggatgtacagtttttgccggatgtggacattccttgtacggagtgtcgtggtaccagatataaaaaagaagcatggcagatcttttacgaaaataaagcaaagaagaaatattcgctgccgcagctgatggagatggatgtgcatacggcgttggaggcaaccaaggatctgaagacagtccatcagaggctggaagtgctggaaaagctggggcttggatatctgacagtgggagaggagacacccagcctgtcaggtggagaggcccagcggctgaagctggccagtgagatgggaaaaggtcagtcagattctgtctttgtgtttgacgagccgaccattgggcttcatccattggatgtattcacactgctgcaggtatttcagacactggtggacaatggtgccacggtgattgtgatcgagcatgatctggatgtgatccgaaacgccgattacatgattgatatgggaccaggcggcggagaagcaggcggacggatcgtggcagcaggaacaccggaacaggtggcgaagaatccggacagtgtcacgggaaggtttctttgctaa

SEQ ID NO: 2722 - DNA, 1734 bp, Blautia sp.
atggactataaagcaatctatgaggaatggctttccaatccgtattttgacgaagccacaaaagctgaactgcgtgcgatcgcagatgatgacaaagagataaaggaacgtttctacaaggatctggaatttggaacggcgggcttgcgcggaattatcggtgcaggtattaaccgtatgaacatctatgtagtacgtagagcgacccagggacttgcaaattatattatcaagcagggaggacagggaaaaggcgtagcaatcgcttatgattcccgtcatatgtctccggagtttgctgaggaagcggctctgacactggcagcaaatggaattaaagcatacaaattcgagtctttaagaccaacaccggagctgtcatttgcagtacgtgagcttggctgtatcgcaggtcttaatattactgccagccacaatccgccagagtacaatggatacaaagtatactgggaggatggagcacagtttactccgcctcatgataaaggcgttaccgcagaggtactggcgatcacggatctgtctacggtgaagactatgagccgtgaagctgccattgcagcaggcaaatatgagatcatcggacaggcgatcgatgataaattcattgcacatgtaaaagcacaggtagtaaatcaggatgccattgataaaatgcagaaagacatccgcatcgtttacaccccgcttcatggtaccggaaatatcccggcaagacgtgcgcttaaagagcttggatttgaaaatgtatatgttgtaaaagaacaggaacttcctgacggagatttcccgactgtcagctatccgaacccggaggcggcagaagcttttacgctgggactgaagcttgcaaaggaagtggatgcagatctggtgctggcaactgacccggatgcagaccgtcttggagtctatgtaaaagatacaaaatcaggagaatatattccgctgaccggtaatatgtcaggttctctgctctgcgactatgtgctgagccagaagaaggctgcaggcaagatcccggcagatggacaggttgttaaatccatcgtaaccaccaatctggtagatgcgatcgcagcatcctatgactgtgaactgatagaggttctgacgggattcaaatacatcggacagcagatcctgaaagatgagcagaccggaaaaggaacgtatctgttcggaatggaagagtcctacggctgtctgatcggtacatacgcaagagacaaggatgccatctccgcaacggttgctctctgcgaggcagcggcttactacaagaccaaaaacatgactctgtgggatgctatggttgctctctatgagaaatacggctattacaaagacgcagtgaaatctatcgaactcaaagggattgaaggacttgcaaagattcaggagatccttgagactctgagaaataatacgccggtcagaattggtgactatcatgtagtatctgcaagagactacaagctggatacgatcaaagatatgaagactggtgaagtaaaaccgaccggccttccggcatccaatgtactttactatgatctgaacgatggcgcatggctgtgcgtaagaccgtcaggtacagagccgaaggtaaaattctactatggtgtcaaaggtacttctctggaagatgcagacaagaagagtgctgcaatgggagaagaagtactggcgatgatccagaagatgctgtaa

SEQ ID NO: 2723 - DNA, 1953 bp, Blautia sp.
atggaaaagaaaaagttttatatgaccacagccattgcctatgcatccggaaaaccgcacatcggaaatacctatgaagttgtactggcagacagcattgcccgttataagagattcgagggttacgatgtatttttccagaccggaaccgatgagcatggccagaagattgagctgaaagcagaagaagctggcgtcactccgaaggaattcgttgacaatgccgcagatcagattaaaaagatctgggatctgatggatacttcttatgacaaattcatccgcaccactgatgaagatcatgagaaacaggtacagaaaatcttcaaatatatgtacgacaagggagatatttacaaaggttcctatgaaggaatgtactgtactccctgtgagtccttctggaccccgtcccagctggtagatggcaaatgcccggactgcggacgtgaagtacagcctgcaaaggaagaggcttatttcttcaagatgagcaaatatgctgaccgtctgatcgagcatatcaatacgcatccggagttcattcagcctgtctccagaaagaatgagatgatgaacaatttccttctgccgggactgcaggatctgtgtgtatccagaacctccttcacctggggcattccggtcaccttcgatccgaagcatgttacttatgtatggctggatgcactgaccaactatatcaccggtatcggctatgactgtgatggagacagcactgagaacttcaagaagctgtggcctgcagatctgcatctgatcggtaaggatatcattcgtttccataccatctactggccgatcttcctcatgtctctggatctgccgcttccgaagcaggtattcggacatccgtggctgctgcagggcgacggcaagatgagtaagtccaaaggaaatgtactttacgctgatgaactggttgatttcttcggtgtagatgctgtccgttactttgtacttcatgagatgccgtttgaaaatgatggtgtgatcacctgggaactgatggtagagcgcctgaactccgagctggcaaatacccttggcaatctggtaaaccgtacagtttccatgtccaataaatatttcggtggtgtagtaaccaacaccggtgtagaggaagatgtggatgctgacctgaaggcaaccgttcttggaactctcaccaagaccaccgagaagatggatcagctccgtgtggcagatgccctgacagagatcttcgcactgttcaaacgctgcaacaaatatattgatgagaccatgccttgggcactggccaaagatccggagaagaaagaccgtctggctactgttctctacaatctggtagagagtatcagctacggtgctgctcttctggagtcctttatgcctaccacttccaagaagatcctggctcagctgaatgcaaaaccaagaaccatcgatcagatgactgaatttggtctctatgagtctggcaccagagtaacagagactccggagatcctgtttgcccgtctggatgtcaaagaggttctggcaaaagtagaagagcacaaagctgctcaggctgcagaggctgctcagaaggaaaatgtcattgatatcgaagcaaaagaagctgtatcctatgatgatttcgcaaaactgcagtttcaggtaggtgagatcctttcctgcgaagctgttccgaaagctgataagctactctgctctcaggtgaagattggaagccaggtacgtcagatcgtatccggtatccgcagcacctacagcccggaggaaatggttggcaagaaggttatggttcttgtaaacctgcagccgagaaagatccgcggactggtatctgaaggcatgcttctgtgcgcagaagatgctgacggcaagctttctctggtcgctccggaaaaagagatgccagcaggcgctgagatctgctaa

SEQ ID NO: 2724 - DNA, 2856 bp, Blautia sp.
atgtctgaagagagaagaaaatttataaagattcgaggtgccaatgagcacaatctgaaaaatatcagtctggagatccccagaaatgagctggtggttctgacgggtctgtccggttcgggaaaatcttccctggcatttgatacgatctatgcggaagggcagagacgttatatggagtccttatcctcctatgcccgtcagttcttaggacagatggagaagccggacgttgagagtattgaaggactgtctccggccatttccattgatcagaaatccaccaaccgtaatccaagatctacggtgggaacagtgacggagatctatgattatttccgtctgctctatgcaaggatcggcacaccacactgtcccaaatgcggcagagagatccacaagcagagtgtggatcagatggtggatcaggtcatggcgctgccagagagaacgaagatccagcttctggccccggtggtcaaaggccggaaaggtgagcatgtgaaagtgctggaaaaagccagaaagagcggatttgtccgtgtgaagatcgatggacatctgtatgatctgtccgaggagatcaagctggagaaaaataacaagcacctcattgagatcgtggtagaccgtctggtagtaaagccggggattgagaaacgtctggcagactcaattgaaacagtgcttggactgtcggatggactattggtggtggaagtgatcgacggggagatcctgaccttcagttccagttatgcctgcccggattgtggtatcagcattgaggaagtggagccaagaagtttttccttcaacaatccctttggtgcctgcccggagtgttccggacttggttacaagatggaatttgacgaggatctgatgatcccggataaagctttgagtattgcagagggagccatccaggtaatgggatggcagtcctgtacggatccgtccagctttacctatgcgatcctgaaagcactgtcagaggcctatgactttgacctgaatactccttatgagaaactgccggaggagatccgtcatatgctgatccatggaactgatggcagagaggtgatggtccattataaagggcagagaggtgaaggcatctatccggtagcatttgaaggattgatcaagaattgtgagagacggtatcgcgagacgggttccgatgccatgaagcaggagtatgagagctttatgaggatcacgccctgccgtgcatgtaaaggacagcgactgaaaccgacttcactggcggtgactgtctgtgataaaaatatttttgaggtgacagatcagtcggtgcgggatctgcagcagtttctggaacagatgacactcactcatcaacaggagttgatcggcggacagatcctgaaagaaattcgtgcaagaatccgattcctgatggatgtgggtcttgattatctgtctctgacccgcgctaccggaaccctgtccggcggtgaagcccagcgtatccgtctggcaactcagatcggttctgggctggtaggcgttgcttatattctggatgagccaagtatcggacttcatcagagagataatgacaagctgctgcgaaccctgtgtcgtctgcgggatctgggaaatacagtgatcgtggttgaacatgacgaggataccatgctggcagcagattatattgtggatatcggaccgggagcaggagaacacggtggacaggtggttgccaccggtacagccatagagctgatggagaatccggcgtctgtgactggagcgtaccttagcggccgtctgcagattccggtgcctgagaccagacggacaccgacggggtggatgaccgtccgtggcgcaagagagaataatctgcggaatattgatgtgcggtttccgctgggagtgttgacctgcgtgacaggtgtgtcaggatctggcaagagttcactggtcaatgagattctttataagacgctggcgaagaccttgaaccgagcaagaaccattccgggcaaacaccgcactgttgaaggtatggagcagcttgacaaggtaatctgtatcgatcagtcccccatcggaagaacgccacggtccaatccggctacctacaccggtgtatttgatatgatccgggatctgttcgcatctacatcggatgcaaaagctaagggttacaaaaaaggacggttcagctttaacgtaaagggcggtcgctgcgaagcctgctccggtgatggaattatcaagattgagatgcattttctgccggatgtctatgtgccatgtgaagtctgccagggaaaacggtataatcgggagactttggaagtaaaatataaaggaaagagtatctacgatgtgctggagatgacagtggaggaagcattggactttttcgaaaatgtgccgtttgtccgaagaaagatccagacgctctatgatgtgggactttcctatattaagctggggcagccgtccactacattgtcaggtggagaggcacagcggatcaagctggctaccgagctgagtcgaagaagtacaggtaagacggtatatattctggatgagcctaccacaggtcttcattttgcagatgtgcataagctgacagagatcctccagagactggcagagggcggcaatacggtgatcgttattgaacacaatctggatgtgatcaagactgctgattatatcattgatatgggaccggaaggcggagacggcggcggaacggtggttgcacagggaacaccggaagagattgcagaagtgaaagagtcctatacaggatattatgtgaagcattatttggaaaaagcgacttctcaaaaacgataa

SEQ ID NO: 2725 - DNA, 1920 bp, Blautia sp.
atggaaaacaaaacagacttcaaaccgtatattccggcagacaaagtgatgcctgaattttcggtgacggctgcagtgctgggatgccttctggcaattctctttggagcagcaaatgcgtatctgggactgcgtgtaggtatgaccgtatctgcatcgatcccggcagctgtaatctccatgggagtgatccgcatcatcctgaaaaaggattccattctggagaacaacatggtacagaccatcggttctgcaggtgagtccctggcagctggagcaatctttactctgccggctattttcatgtgggcagtagagggaaaatgtgatgctcctggtatcctttctatcgcactgatcgcactgtgcggaggaatcctgggtgtacttttcatgatcccgcttcgtcaggcactgattgtagacgagcatggaaccctgccgtatccggagggaatggcatgtgcagaggtacttctggcaggagaagagggtggcgaaaaatctaccgttgtgttcagcggacttggaattgcagctctctataaatttatcacagacggactgaaactgttcccgagtgaggtggcatttgatatcaaaacacctatctacaccggaggagttggaatggatgtacttccggcactggccagtgttggatatatctgtggaatcaagatttcaagctacatgtttgcaggtggcgttctttcttatctggtgcttattccggctattgtatactttggcggtgaaagcctctctgtagttatggacagtgctggaaatgccatcgcgttcaatgcactgagcccgggagcgatctggagcaactacattcgttacatcggtgcaggtgctgttgcggcaggcggtattttaagccttgtaaaatctcttccggttatgatcaaaaccttcgtaaaagcaatgaagggatttggtaaaaacgcagaaagcggaagcagaactgaggtaaatatttccacaaaaacagtattgatcggtgtgatcgcagtagcagttgtaatgtggcttcttccggagatcccgatcagcctttccggtgcattgatcgttgtagtatttggtttcttctttgcatctgtttcttctcgtatggttggtctggtaggaagcagtaataacccggtatccggtatggctattgcaaccttgatcgcaacaaccattattttcaaagcaatgggtgtaactggtgtagaaggaatggttgcagcaatcagtgtgggaactgttatctgtattatcgcagcaatcgcaggtgatgcatctcaggaccttaagacaggatatatcgtaggtgcaactccgaaaaagcagcagatcggtgagatccttggtgcagttgtagctgcatttgcaatcggtggtgttatgtacctgcttcatgcagcatggggatttggttctgaagcaatcccggctccgcaggcttctctgatgaagatggttgttgagggcgttatgggaggaactcttccgtggacactggtactgatcggtgtgtttgcagcagtgatcgttgagatccttggaatcccggttatggcatttgcagttggtctgtatctgccgatctacctgagtaccccgatcttcatcggtggtgtgatcagatggttcctggagaataaaaagaaatttgcagatgatgcaagcagaaaagatttcattgaccgtggagttctgtatacttctggtatgatcgcaggtgagggtctggttggaatccttctggcagtatttgctgttgtgggactgaactttgacttctctggtatctatggtggaagctttgagacagtaggtgcaattgtaggagtgatcgcatttgcagcattactgggaagtatgatgtatttctgtaaaggaaagaaaaaacagaatgcctaa

SEQ ID NO: 2726 - DNA, 258 bp, Phascolarctobacterium succinatutens
atggtagggattatcaataataaaaaaagacttctgccgaatccgacaaaagccataaagacagaattaactaatgacaattattccatgcaattagtaaacccaactgcctccatcacccgtggattcagaataaagcatgggctgactgctgacttagacacaaggccttcacagcggcgggaccgtcaggagttaaccatcttgtcaattaagaatgaatcacccacaccaataacctgttttattatatcataa

SEQ ID NO: 2727 - DNA, 489 bp, Phascolarctobacterium succinatutens
atggattgtacaatcctgatagaagcgcagctaaagcaaaaccccggcatttgccgcatcgtaaacgatgcgtctgtgccggggcttttgtcaggacgctttgctgcagcattacctgaagtaaagcttaatgtaagcactcttttttgcaagttaaccagaaaaacacagctttttcgctcaaaatgtgctacaatatatttacgaaaaacgaaaggagtgtttcgtatgtctgaagtatctcaagaaactatgatgttcaaacgtgagccggaaaagctgaacgttgccgaaactataaaagaagtatatgctgccctggaaaagaagggctataaccctgtggaccaattagcaggctacctgctgagcggtgatcccacttatatcaccagctttgaggacgcacgtaccaagctgcgccgtcacgagcgctatgagctgattgaagagctggtaaagaattatctgcagcagattaacaagtaa

SEQ ID NO: 2728 - DNA, 330 bp, Phascolarctobacterium succinatutens
atggcaaatgctgtaaagctgcatgttaaaaaaggcgataccgttcttgtactgtccggcaaggataaaggcaagcaaggtaagatcgttgaagctctgcctaagaaagccaaagtggttgttgaaggcgtgaataaagtaaaacgtcataccaaaccgtctcaggcaaatcctcaaggcggcatcattactaaagaagctccgctcgcttcttccaaagtaatgctggtatgcccggtttgcaaacaagctacccgtattaaaaagaccgaagttgctggtgctttcgtaagaacctgcaaaaaatgcggtgaagtaatcgataaataa

SEQ ID NO: 2729 - DNA, 354 bp, Phascolarctobacterium succinatutens
atgtcagcagaagaaatttttgcgcagcgtatgcgcttaggcaggctctttgatatttacggcggacttctgacagctaagcagaagcaatgcctgggactgtatttctatgacgacttgtctctgagtgagatttcggaggagctgggcgtttcgcgtcaggctgtccacgacctgctcaagcgtgttgagcagctgctagaacgatatgaagcatcactgaaggtgctgagccgcgaggaggagctgcatgctaagctgcagcaggcaatagatttgctggcaactccggaagctgctaaaaaagacgaggccgtgcaaatgctgaaagagctttgcagtgaaggtaggtag

SEQ ID NO: 2730 - DNA, 918 bp, Phascolarctobacterium succinatutens
gtgtttaaaaataaagaggggttacaaatgaagattattgatgcccatatgcattattacaatgttgatggttttgtgcaggttgcagccaatgcaggctatgaaaatacagcggcctgctggcagaaaatatgcgaagaaaacaatatcgtcttttctgtagctatgggcaacactaattatacatcttcgaaatacggcggtgtcacaccgcgcatgattgaccttgcagcgccttttgacgaggatcattacaatcagccgcagaacatgggttactgcatgggtgtaaacagcgaggctataaccgaagcaaatgcggaaaaaacagcgcaggaatttgaacgcttcattaaggacccgcattgtctgggcattaagctctatcccggttataacgctgtctatgtcaacgataaaaggcattggccgctgtttgagctggcacgtgcctataatgtgcctgttgcaattcacacaggcgatactgcctggcccagcggtttattgaaatattcgcatccgctgactgttgatgaagcggcagtggcgtttcctgatgttagctttgtcatagcgcactgtggttgcccgtggttcgccgatgcggcagaggtggcctgcaagaacgccaacgtatgtattgacctttccggtttggtggagggcaatcctaaaccgctgatgctgctcgaaagacagcgtggctttttgcgtcagctgcatacctggctgaattatcttggcaattatgaaaaaatcatgtatggcagcgactggccgcttgtaaatattcccctgtatatctggatgatcagccacgttgttcccgaatgctatcacgaggatgtattttataacaatgcagtaaggatttacagtaaaatcggcaagctgctggaaaagtgcggaggttga

SEQ ID NO: 2731 - DNA, 861 bp, Phascolarctobacterium succinatutens
ttggcacaaaagcctttgtttgaaagctatatatcaaaatcacatcaaaatggcagcgaatgtgccttttccaatctttttatctggcgtgactgctatcatatttattggtgcgtagcgcacgatttccttttgctgaaggttaaacgcaacaacgttgatttctacattcagccttttggcggacgcgatgaggatttgccgcgtctgatgcaggagctgaaggaggagcatcagggcaaaccgtttgaaatgcatggtatctatgattttaccaaggagcgctttgagcgcgtgatgccgggtctgacatatgaagaagaccgcgacaactgggattatgtatatctgcaggaaaagctggcaacactttccggccgtaagctgcacgggcagaaaaatcactataatgccttcgtcaaggcgcatccggattttgtttatgagccgattaccatggataatatgatggaatgcctgaacttcggcgagcgctggtgtgatgagcatatggcagaggatccttcgctgctgtgcgaaaaatatgctatccaggaggccttcctgagcttcgagcagctggagctgcgcggcggtgcaatccgtttcaacggtaaaattcaggccttcagctttggcaagaagattaacgaggatacagcggtgctgcatgtagaaaaggcgcgtcatgatgtacgcggcctgtatactgctattaccaaggagttcgccgctcatgcctggacggatgtaaaatatctcaaccgcgaggaggatatgggacatcccggtctgcgtgaggcaaaaatggcgctgcatccggaatttatggtgaaaaaatataatgtaattattgggtga

SEQ ID NO: 2732 - DNA, 630 bp, Phascolarctobacterium succinatutens
atggaatatttggttgtaagtttaatgtttatcgttttcctgcagacgcgctttgtggagctgcgccgtgcaactctgtgtctggcgctgcaatctgccttgattgctgcagcctgccttgtcgtaggtatgagccatggcagcggtttgcatgcctggctgcctggtgtgctgacgattgccgttaaggtgctctttattccttacgctattttgcgcgtggtgaatcagctgcgcgatgagcgtgaaattgtcagcgatatcaatgtaaattattctactgcctttgcagcctgcagtctggcactcggctacatggtaattgacggtctgctgccgcaggcagagggacgcgatattctggcgacctctatgtttatgattatgacaggcctcgcgctgattgttatgcgtagccgtgccattatgcagatgattggcctgattaccttggaaaacggcatttatctgctcggtctgattatgaccgaaggcttgccgctgattatcgagctgggcattttccttgatgtgctgattgctgttgttattcttgttattttaacctcgcgtctgcgtctgtcgtttaaaactacggatacaaatgtgctggacaagctgaaagggtag

SEQ ID NO: 2733 - DNA, 309 bp, Phascolarctobacterium succinatutens
atgaagcagttgcttaacttatttacttttaatacttactgccgtcaaagcattttcttaatggtacaaatgtgctataataaaaacgcaataagaagcaggaggtgcgctttatttatgaagaaaaaagagcgtgacaggctgcaggtagaatatatctgtcctgattgcggcaaacatttggcttgggcgctgcctaccgctgtaatacaatgtccgtgcggacagtgggtggataataacaatcgtttaaaagataagagtgaggtttatctgcctttagacagtgagcagactgtacttttttaa

SEQ ID NO: 2734 - DNA, 372 bp, Phascolarctobacterium succinatutens
ctagatacgatagaacgagaggagggacatgaaatggctgaggattgtattttttgcaaaatcattaagggcgatatcccttctaccaaagtgtacgaagatgataaaatgattgctatcaatgacgttgctccggctgctccggttcatgtgctgctgatgcctaaggaccacacagctaacatcactactgcggaccccgagctggttgcatatatgctgggcaaggttaaaatgatcgctgaaaagaccggaattgccgaaaaaggcttccgcgttgttatcaacaccggcgatgaaggcggtcagacagtaaaacatttacacattcacgtaattggcggcaaagctttgggttggcccccgtgctaa

SEQ ID NO: 2735 - DNA, 192 bp, Phascolarctobacterium succinatutens
ggagaccatatgagcttaaaaataattactaagcgttgcaaaggctgtggtatttgtgcggccttctgcccgaaaaaagttctggcagtcagcgaagtcggcaaagtcgaagccgttgctgaagaaaattgcatcaaatgcggacaatgcgaaatgcgttgccccgactatgctatctttgtagataaataa

SEQ ID NO: 2736 - DNA, 204 bp, Phascolarctobacterium succinatutens
atggaaattccacaggttttggcactgcctctcaaggaggctgcccgtcgcctggaggccgcaggctgcagctatgaggtgcagcctctgctgccgccgcgtgcaagcgaggcagactttgaaggacgtgaggtgcgcagatatgtagtaagacaacagcagttgtctgctaatagattagctcttaccattgtgtatagataa

SEQ ID NO: 2737 - DNA, 390 bp, Phascolarctobacterium succinatutens
ccgccggtaaccataataatttttccaggcatatttcaacctcccttcgtttttgtaagctgcatgcttttcattttatacatatatgaaaaaagctcccttgcgggagattcacaaaatgcagctgcagccaaaaattctatatttacgcataccaaagccagcctatctcccgtaggctccaagcttcgtaacaggcaggtctcctggcttagcttcatcgccctcagcgccttcccaacttgcgtcagtgacataattgcctgggctccgcttacagtagcgggactgctccggattctcaccggcattcccttttcagcaccggcctcaaccggcgcacctgtcaaaaaaattccaagtatatatattcgacagcaattcctataa

SEQ ID NO: 2738 - DNA, 561 bp, Phascolarctobacterium succinatutens
atgaacgcttgccccacagaggatgagcgcaagggcgcagcgcaagacgatgaacctgctgtgccgcttcttcaagaggcaggtcctcacggctgccgccgcgttccagcacgcaaagaggcgcttcgctgccaacctctccgccgggcagtaaatatattcttcgttatcattgtcgccgaaaataattccggcgagcagtttttcttgcgtaactttagacattttctaacctcagaacattctcttcttccacagcaggaaggcagtgccgatggcaatacatgccgccagactgatgacgagaaggaacccgaaggggttttctgcaagggaacaggaacgatcatgccccataaaccgctgataagtgtaggaatcgccaaaatgatggtgacggatgccaaaaatttcatgactaggttcaggttgttgctgatgatgctggcaaaaacttccatcatgctgttaagaatgtggctgtacatctcaaccatctctacagcctgcttatattcgataataacatcgtccagcaaatcctcgtcttcttcgtatacc

SEQ ID NO: 2739 - DNA, 753 bp, Phascolarctobacterium succinatutens
atggcagagaatttattagaggtaaggaatctcgtagtcaatgtagaggacaaagagattctgcacaatattaatcttgatattaagccgggtgaaactcatgtgcttatgggacctaacggtgcaggcaaatccaccttgggttatgcgctgatgggtaatcccaaatataccgtaaagggcggcagtattaattttgccggcgaagacattaccaaacttgccgtagataaacgtgctaaggcaggtctgttcctttccttccaaaatccgctggaggttcccggcatcagtctgagcagctttttgaaaactgctttggagcagcagcgcggtgtacgcatcaaggcttgggatttccgtaaggagctgcgtcaggctatggctttgctgcagatggacagcaaatatgccgagcgtgacttgaacactggcttcagcggcggcgagaagaagaaggcagaaattctgcagcttttgatgctgaatcctaagctggcaattctggacgaaacggacagcggtctggacgttgacgcagtgaagattgtttctcagggcattaaaaccttccaggagcatcgtcagggagcattgctgataatcactcataatactaaaatcctggatgcactgcatgttgaccacactcatattctggctcagggacaaattatcaaaaatgccggtccggagctggttgatgaagtcagcaaaaatggctttgaaaagtttttgcagaataaggaataa

SEQ ID NO: 2740 - DNA, 633 bp, Phascolarctobacterium succinatutens
ttaaattatagcggaaacagggagacctttcaggccatccctgttttctgctcaataaagaggggccgaaagcttgcttttggtgttgctctgaggtatcaaaaaaggagaaagaagcgttctatgtcaagaataaacagtaaatttattgttatcgctatctccgtgctgttgcttttatactttgttatcttcccgatgggaattctgctgtatgacagcatcatgctggatggcgcaattaacttggaaaactatcgcaatgtatatagtcaggatgtcaactggcgtgcgttgacgaatacaatcgagctgtctttgggcgttatgattgtcagtgtgctgattaccttcccgctggcttggctggttggccgtactgatatgcccagcaaaaaaatctaccgtactctgctggtatccagctacgtgattccgccgtatgtaggcgctattgcctgggtacagctgctgaaccccagtgtaggttatctgaatgagattcttaaatttgtctttggtctggaaacagcaccctttgacatttatactatggctggcttaggctgggtactgactttgttctactctccctttgctttcatcaccatttcccgtgctatggagaaaatg

SEQ ID NO: 2741 - DNA, 990 bp, Phascolarctobacterium succinatutens
atgcaaaaaattattgcactggccgagaaggttttaaacggtcaggatattactaaagaagaagctgaatttttgattaacgtgagcgatgacgacaccatgctgcttttggccatggctgacaagattcgccaaaaatatgccggcgatgctgttgactgctgtgcaatcatcaacggccgcagcggtaaatgcagcgagaactgcaagttctgcgcacaatccgcacattatcataccggtgttaaggaatacggtctactgagcgaagaggaaatcttcaatgcagctaaaaaagctaaggaagcaggtgctgtacgcttctccatcgttaccagcggtcgcggacagagcaaggctgatgactttgaaaatatctgccgtaccctgaaacgtattaaagaagaactgcacattgaggtttgcgcttctttgggcattttgactgtagagcaggcaaaagagctgcgtaaagccggcgtaacccgctaccattccaatctggaaacagcaggcagcaacttcccgaatatctgcagcactcatacctatgctgataaatttgttaccattaaaaatgctcaggctgccggcctgcgcgtttgcagcggcggtattttaggtcttggcgaaacacgcgagcaacgtgtggaatgggccttcactctgaaggagctgggtattgacagcgtacctctgaatatgctgactccgattcctggtactccgtttgaaaacaacaaaccgctcccgccgctggaaatcctgcgtgcgttcgctgttttccgctttgttctgcctaaggcacaaatccgtaccgcaggcggccgtgaagtaaacctgcgtgatttgcaggcactggcactcaatggcggtgcaagcggcattatgatcggcggctatctgactactgccggtcgtggcactgaccgcgatatgcagatgctcaaggatcttgatcgtccgcgcagcatgccgaatcttgattaa

SEQ ID NO: 2742 - DNA, 222 bp, Phascolarctobacterium succinatutens
aaagtgaagagtggttatcttcactttatctttaaaattggagaaaaaatgacaaaacgagaacctaaaccccctacatttaaagattatttgcaggccttttcagattatctgagaaggcctaaaactgtttttgattttaaagaccgtacaaagggaattttattgcttattgcgataataattctgctgcagaaggttgtacaaatgctgagtgattga

SEQ ID NO: 2743 - DNA, 192 bp, Phascolarctobacterium succinatutens
ttgtgtataagattctaccagatttttatatcaccgctgaaaccgccgacctgcaggttttatcctacatgttcagcgtatgctattgaagcgattcagaagaagggtcctgtgaagggaacgtggctggcgattaagcgtatcgcaaaatgtcatccttttcattcgggcggttatgaccctgtgccataa

SEQ ID NO: 2744 - DNA, 1146 bp, Phascolarctobacterium succinatutens
atggagaaaaagaagctgggcggtctgctgctggcattatggctggcggtgctaccgctttacggagccatgtgctttgccgatactgctgacgacaagcgtgcggagcttaacgatgtacgtcagcgtatggagcggatgcagacccgcaaggagcaggcgcgcaggaaggctgaaagcgccagcgcggagcttagcgaggttatgagcagtcttaacgagctgcaatcacaggctaataatctgcagaaaaaaagcgatactctgcagggaaaaataaatgataaccaggctaagctggagaaaaagcaacaggaaatgcaggcgcggatgttgatttaccgcaagcgtctgcgtgatatttatatcaacggccagataaattatctggatgtgcttttgggtgccaaggatttcagtgatttttcctcgcgcatgtatttgctgcaaaaaatcatcagccgcgacctggagctgttggaaaagctgaagcaggatgctgcggaaatcaacagccgcaaagagcagctggcagctgaaatgaaggaaatcaaggctacccagacagagctggaagcaaaaaaggctaaagtaaataagctgcgtgagcagcgtgcctatatgctttacaaggcacaggaggaagagcagtccagccaggaggaatatgagcgtctgctggctatttcggaaaatatcgcctctatgttgcgtaatatggaaaatgcaggcggcggtgctcctgcaggacaaggcggtacaggtcagtttatgtggccttgtaacggtccgattacctcctactatggttggagaacgcatccgattttcggtacaaccaagtaccatagcggtatggatattgctgttgattcaggaacgccgattcatgctgctgacagcggcactgtagtttacagcggctggctcggaggctacggcaactgcataatgattgaccatggcggcggtcttgtaactctgtatgcacataattcggcgttaaatgttggtgaggggcaatatgtaagcaagggcacagttgttgcttatgcaggcagtaccggttattctaccggtccgcactgtcattttgaggtgcgtctgcatggagagcttacagagccgttaaattatttgccatga

SEQ ID NO: 2745 - DNA, 444 bp, Phascolarctobacterium succinatutens
atgatgaaaatggctaaaagaaacactattcaaagacaacttgttatcgcggctgtacgttttttagcagatcaccctactgctgaagaagtatatgatcgcattactatggagtatcctgatatcagcaaaggtaccgtttaccgcaaccttaattctctggttgaaagcggtttgctgagcaaggtttccgttccgagcggtgccgatcgttttgatcatatcctcgcaagacattaccacatcaaatgcactgaatgcggtaagttcatgaacgtagaaaactttgattatattccggatatggatgaaaaggtagctgctgtaaccggctacaaaatgaatcaccatgatattgttttcagcggtatctgccccgaatgccaaaaggaaatggcagagcaccctgtaagcgaagaagttttgggtgatgaccaaaactga

SEQ ID NO: 2746 - DNA, 165 bp, Phascolarctobacterium succinatutens
atcggcagcgtaacgtgctggaaacgtctgctcctacttggttcagagaagctgctcgcgggtgagcttctttgcctgcttgttggcggcttgcaccatacgccgtctctctggatgctggggcaggtaaattttcccggtcattgcattttgttcttaaattaa

SEQ ID NO: 2747 - DNA, 264 bp, Phascolarctobacterium succinatutens
ttgccgaacattaaatcttccatccgcagtgtaaagaccgacgcagaacgtcgtgctaaaaacgctccgattaaagcagctctccgcaatgcttcccgcaaagtagaagctctgactaaaaccggcgctaaagaagacgctcaagctactatggctactgcttccggtttgctcgataaagcagctcgcaaaggcattatccataagaatgctgcagctcgcaaaaaatccagacttgcaaagagaatcaacgctatggcttaa

SEQ ID NO: 2748 - DNA, 822 bp, Phascolarctobacterium succinatutens
atgaagtttttatttgtaaccttatttcccgaacagattgagcaggccgcaagccacagcattttgcagcgcgctgcctccaagggcctgattgaggtgagctgcatcaatccgcgtgattttacgcatgacgtgcatcgcacggtggatgattctcccttcggcggtggtgccggcatggtgctgaagccggagccgatggtggctgctatccgcaaggcgaaggagcagctgcccaacgcccgtgttattgcgatgtgcccgggtggacgcacgctcaaacagagcatcgtcgaggaatatgcccacagcggacaggatttcatcttcgtctgcggtcattatgagggctttgacgagcgcatcttccattgggttgatgaaaagctgtctatcggcgattacgtgctcaccggtggcgaaatgcctgctattattgtgatggatgcaatttcccgctttattcccggcgtattgggcaagattgaaagtgcggaggaggattccttcagcaccggccttctggaatacccgcagtacacgcgtccggtgaactttgagggcatggaggtgcctgaggtgctgcgcagcggcaaccatgcgctgattaacagctggcgcctgaagcagtcgctcaaggcaacgcttgctctgcgtcccgaccttttgagtgcggagcagaaggagcttttgacaggccgcttgccctataaaatgaaaaaatcggagcgccgcttctatgaggagctgcgtgccgaaatagctgccgagcaggaaaaacgcgcaagcgccgaggtgaaggaggatgaggcgaatggctga

SEQ ID NO: 2749 - DNA, 702 bp, Phascolarctobacterium succinatutens
atgagaggcaaactttatagtgttggtatcggtcccggagacccggaattaatgaccctgaaggctgtacgcctgttgaaggaatgtgacgttgttgcattgcctaagggagataccgacgtaatgacggctaaggaaatcgttaatcacgtagtagatcttgatgcaaaacctcagcttattatttatatgcctatgactaaggacatggcagcaatggacaaggcacaccgcgagggtgcagatgctattgaaaagctgcttgatgaaggcaaaaacgttgttttcattaccctcggctgtcctaccgtatatgcaacctgcatttacgttcataagctggtgctgaaggatggctatgatgctgagctggttgcaggcgtaacctctatctgtgctgttgctgctaagctgaacacttccctgtgcgaaagagcggaaccgttgattgttctgccaggcagctacaagcagtccgcagcgttccttgatggccccggcaacaaggtgctgatgaaatctgcaagcgaaatcggccgtgtagttgacgagctgcgcgagcgtaagctcatcaaaaattccggtatggttgaaagatgcggcctgccgggtgaaaaaatctatcgtaaccttgaagaagtagatcctaagagcagctatttctctgtaatattggttaaagaaaaggagtttgatgaataa

SEQ ID NO: 2750 - DNA, 669 bp, Phascolarctobacterium succinatutens
gtgaagatcatagctttaagcaacaggcagaagcaaattgctgaaattgtacgtctggacggacctattaccggcgagcatatagccgaaaggctgaatgtaacccgcgctgccttacgcagtgatctggcaatccttgttatgggtggtattcttgatgcgagaccgaaggttggttatttttataccggtaaaaatactttgggtatgctgatggaagaaatttctgctattactgtgcaggatctgcagtcggtaccggtagcgattaaacatgacaagagcgcctacgaagcagttgttaccatgttccttgaggatgtcggaacggtgttcgtgctggatgaggaaggcatgatgaacggcattttgtcgcgaaaggatttactgaaggctgctatcaataataatgatttgcgtgatattccagtggtcatggtaatgacgccgatttccaaaatcatcgtagctacaccggatgagcctgccgcttcggcagctcgcagactgattgataatgaaatcgactgtctgccggtagtaaaaatcattgatgaaaagaagcgcatgtatcaggttctgggacgtatcacaaaaactaattttactcgtctgctggtagatctggctgagggtaaggggggtaattatcataataacgaagcttaa

SEQ ID NO: 2751 - DNA, 2679 bp, Unknown
  Description of Unknown: Firmicutes sequence
atgcactttaacggtttgaacgaccaggaagtggaacaatcccgcagaaccaacggcagcaacgccatcccggactcggagccgacgactttctgggcggaattcaaggagacctttggcgaccccatgatcaagatcctgctggccatcgccgccatcatgatcatcatgttcgcctttggctactccgacatctacgagccggtgggcaccatcgtggctgtcctcatcgtggccgtggtcagcgccaagaccggcgtggccagcgacacgaaataccggcaattaaaagattccacgaagaaagaccagtgtaaagtctatcgcaacggcgtcatcaccgtcatcgacgtggatgacgtcgtgctgggcgacaaagtcctgctgcagtccggcgataaaatccccgctgacggtattttgattgccggcgacctgcgcgtggacaactccgccctgaacggcgaggccgaggaatgttccaagaccgccgccgccgagggcacgaagctggccgatgacatcaccggcgatacgtttgtcgatgcccactccctcttccggggcgccgtcctgttcgacggcgagggcgtgatggacgtgcagaaggtcggccttgctaccatgatgggcaaaatggccgaagagatgcaggagaacgagccggactcccccctgaaggtgaagctggctaagctggccaagcagatctccaccttcggctatatcggcgccattgtcatcgccgtcatgtactttggctactttatcctgcaagccggcggcttcgggccttattttgcggcgtccccggcggatatcatcaaggatgtcgttgaggcggtgtccctggctgtcgtcatcatcgtctgcgccgtgccggagggcctgccactgatgatctccctggtgctcatgcagaacaccagcaagatgctggaccacaacgtgctggtccgtaaggccgagggcatcgagaccgccggttccctgaacatcctgttcagcgacaagaccggtaccatcaccaagggccagctggaggtcgtggagttcttcaccgctgacggcctgaccatccccctggaggagctgagccagcacgggaagatcaagggcctgctcgacctggccatcggcaagaacacgcagtccatgtttgacgcggacggccgcgtgatcggcggcaacgccacggaccaggccctggtcaagttcctgggcaaggagagcatggcccagctggagggcgtgtgcaagaccgtcaaggtgcagggcttcaactccaccaacaagttcagccaggtctatctgggcgacatgggcaagacgctgtataagggtgccccggagcgcctgctggccacggcgaagaagtacctgggcctgaacggagagatcaaggatctggaccccaaggtcctggatgccaagatcgtagagctggccgacaagtccatgcgcgtgctggcctttggctactccgagcaggccatggtcgagaataaaatccatgaggacgtggttttgatcggcttcgtgggcatccgggacgacgtgcgccctgaggccagagaggccattgccgaggtgcggcaggcaggcatccaggtcgtcatgatcaccggcgaccgcctggagactgccgttgccatcgccaaggacgcgggcctgtaccacggcggcgacgaagtcgccctgacgtccgcccacctcaacgagctttccgacgacgaggtgaaagaaattatcccccgcatccgggtcattgcccgcgccctgcccacggataaatcccgtatggtccgcctgtgccaggagatgaatctcgtggtcggcatgaccggcgacggcgtgaacgactcgcccgccctgaagcgggctgacgtgggcttcgccatgggcagcggcaccgaggccgcgaaagaggccggtaagatcatcatcctggacgataacttcaagtccatcaaggatgccatctggtatggccggacgatctaccataacatcctgaaattctgtaagttccagctggtcatcaacgtggccgctgtggtcgtcagcgccatcgcccccttcttcggggtggaggagccgctgaaggtcacccacctgctcttcgtgaacctggtcatggacggcttgggggccatcatgctgggcaacgagccggcccttgcgcggtatatgagggaaaagccccgccgccgggacgagagcatcatcagcaagcccatgatggggcagatcctgaccatgggcctgtggctgaccgtgctgagcttcctcttcctgaagctgccggtgtttgaccgcatcttccctgtgcaggaagagaagctcacggcctactttgtcctcttcatttggagcgccctgtttaacggcttcaacgtgagagacgacggctttggcatcttccgtgggctgaaccagaacacgggctttatgaaggtctttgccatcatcgccatcgtgcaggcggcgatcgtcaacgcaccgctgatcccgttccaggtcttcacttggatcggcgacatgttcagctgcgtgcccttcccgcccctgggctgggcggtggccattgtgctggccttcaccatgatcccggtggacctcatccgcaaggcggtcaccaagcaggagagccacgatctgatcgggcagtccaaataa

SEQ ID NO: 2752 - DNA, 1629 bp, Unknown
  Description of Unknown: Firmicutes sequence
atgaagcccaagcatcccctgacccagttcgccgccaagcaccagtccctgctcctggtgctgatcggtctggccgtgctgatcggggccttcgtggccgcgaccaagtccaatatggcaaacatccagagcaccctgtccaacaccaccagctacgtcaaagagcagtgcaaccactacgcccgcatccagctggcttccgagaccaagagcctcatgcggatgacggaaagctgcaagcagatcgtccaccagctggcagagagcaacacggcggcagacgagaccgccttacagcgctgcgcggaaaacacctacgtttccggcgtcctcctgctggacccccagggggagatcctggcccaataccacgccgagggtcaggccccggccgatctggcggactacctggcctcccccgccttgcgggacacggtctcctacccggaaaaacgctacgccgcccgcttttactgcgaggacggcagcgaggtggacctgaccgccgcccgccgccaggaccaggcggggctggtcgtggcctattaccacacgacggtggaatacctggattccttcagcctgtccatcacctccatgctctccggctacgaccaggagaacaacgggatcatcgtggtcagcaacggcagcgacatcattgccagcaacgaccccaccctcatcggctccagcaccgatgacctggagatcctgcggaagatcaaggccgaggggatcagcgacaagctggtccaggccaagcagggcgacgggacctttgcccgttacctcggcctgatggagcgggggcgagactgctacgtctacgccttcctgacggagcagaccgttttccgcagcacccctcggacgatggtgtatgccctggtggcctacctgatcctcttagccgtcaccaacgccgtccgctggagaacggcccaggtttaccacgatgagcagatccaggcacagatcaagcatgccaacaacctccgggagaaaaatgaacagctcatccgcgccgtggaccaggctgaccgggccaacgccgccaagaccagcttcctctcccacatgagccacgacatccgcacgcccctcaacggcatccttggcctgttacagatcgatgctgcccacccggacgacaccgccctcctcagcgccaaccgggaaaaaatgcgggtggcggcagaccatctcctggccctcatcaatgacatcttagagatgagccagctggagagcggagagatcgtgctggccagagaacctctggacctggaaacgctgacctcggatgtcttcaccatcatcgagcagcgggccgctgagtccggcatcaccatggtccgcgacgagcgctcagaccccatggagttgccctacgtctacggcagcccactccacctgcggcagatcctgctgaacatctacaccaactgcatcaaatacaaccgggtggggggacgcatcaccacgcgcttccaatgcctggggaggaaaaaccaggtggtgacctatcgctggaccatttccgacaccggcatcggcatgagcgaggcgtttttggagcatatcttcgaccccttctcccaggaaaacgttgccgaccgaaagggc

SEQ ID NO: 2753 - DNA, 2238 bp, Unknown
  Description of Unknown: Firmicutes sequence
atggaggacaagctagccgctcggtttgccgagctggaagaaaaaatcaagaacatgccccaggaggagcaggaccgggtgcgggacgcctacacctacgccaaggagcaccacgacggccagctccgcaaggacggctccccttatatcacccaccccctggaggtggcgcatctggtggcggacctggggctggacgccgactccatcatcgccgccctgctccacgacaccatcgaggacaccgacgccacccatgaggaggtcgccaagcgctttggcgtcaccgtggcgaacctggtggagggcgtgaccaagttaaacaaggtcaagtatacctccacggaagagaagcagatggaaaatctgcggaaaatgctcatggccatggcccaggatgtccgggtcattctgatcaagatctgcgaccgggtgcacaacatccggacgctggaataccagtccgagaagaagcagcgggagaaggccctggagacgctggagatctacgcccccatcgcccaccgcctgggtatgcagcggatgaaatgggagatggaggacgagtccctccgcttcctggaccccgtggcctacaaagaaatttcggacgagctggcggcccaggccaaggcccacgccgcctttatggagcggatccaaaacgagatccaggaccgcctgaaaaaagagggcatcaagggcacggtctacgggcgggtgaagcacgtctactccatctaccggaagatgtacgcccagaacaaaaagctcagtgagatctttgatctctatgcctttcgggtcatcgtggatgacatccccacctgttacagcgtgctgggctgtatccacgacatgtacaaggcggtcttgggccgctttaaggactacatcggcacgcccaagcccaacatgtaccagtccctccacaccaccgtcatcggcagcgagggcatcccctttgaggtccagatccgtacctgggagatgcaccacatggccgagtacggcgtggcggcccactggaagtataagcagggcctgagcaacaagcagctgggcaccgaggagacctttgcctgggtgcgccgtctgctggaaaaccagcaggacaccgaggcggaggaatacatccgctcgctgaaggtcgatctcttcgccgacgaagtctttgtctttacccccggcggcgatgtcatcaatctgcccgccggggcgacccccatcgactttgcctatgccatccactccgccgtgggcaactccatgacgggggcgaaggtcaacgggcgcatcgtcggctttgactaccgcctgcgctccggcgagatcgtggaggtcatcacctccaaaaacgccaaaggccccagccgcgactggatgaagctggccaagagcaaccaggcccgcaccaagatccgccagtggttcaagcgggagaagcgggaggaaaacgtggcccacggccgcaccatgttcgagggggagatcaagcgcctgggcctgaccatcgccatgctcaccaccgagtcgatgctgccgcacatcctggaaaaagtccgcttcaactccctggaggagatgtacgccgccatcggctacggcggcgcctccgcccagaagtgcgccaaccgcgccagggaagaactcatccaccaggaccgccaggaggccgagcgcctggccgccgagaaggccgagcaggaggcccgccagcaggaggaggtcaccgccgccctggactccggcgtggccaagtccggcaacaagaagcactccgtctccggcgtgatcgtggcgggcatgacggaatgtatggtcaagttcgccaagtgctgcacccccgtccccggagaccccatcgtgggcttcatcaccaggggctacggcgtgtcggtccaccgggcggactgtcccaacgccatcagcggccagacccgaccaggggaaaaagaccgctggatcaaggtcagctgggaccccgacagcctcaacacctacaagacctccctggacatcatcgcgaaggaccggcccggcctggccatggacgtgaccacggtgatggccacggcaaagatgaatattttggccatgacggtcaacgtcctgccggacgggtacaccaagtttaatctggtggtggaagtccggggccagggcgaggtcacgaccattatgaataagctcaaccaagtgaagaatgtgtatcaggtgtcgcgggtgagcgggtaa

SEQ ID NO: 2754 - DNA, 1554 bp, Unknown
  Description of Unknown: Firmicutes sequence
atgtacgaatccaacaagaacgacagcagcaaggcaaagctgtattggaccgtcggcatcatcattgccgtggccgtggctgcgcttctgatctggcacaccttcttctacgggaccgaaaacggcaccgccgccaccgtgggagaccaggagttctccaccgtagaagtgacctactactacaacaccgtcgccaacaactacatcaaccaggcccagcagtacaaagcctatgggatcgacatgggctacgacaccgacaagtcccccgccgagcagacctacaacgaggaggagggcaccacctacgccgactacttcctggaccaggccctgacccagctccagcgcaccgccatcctgtgtgaagaggccagcaaagagggctacaccctctccgccgacggcgagaaagccgtgcaggacaacatgaccgccctgtacacatacagcgttcagagcggcgccggctccgaggaggcctatctccgcgccatctacggcagcaagatgagcaagtccctcttcaaggacctgctgacccaggccattctcgctgacgagtacgccacccacaagagcgagaccttcacctacaccgacgagcagctgaacaagtattacaacgagaacaagaacgacctggattcttatgaataccgttactgctacgtcaacgccgacttcccggagcagaagaccgacgccgacggcaacaccgtggacctgaccgacgagcagaagcagaccgccatggacggtgccaagaccaaggccgacagcatgctcgccgccgtccaggccggcaccgccttcaacaccgctgcccaggacgtgctggacgagacctctgccgagtcttacagcgaccccgaatacaaccacaagaacgacctgggctctgccctgacctccacctaccagtcctggctgaccgacggcagccgtaaggccggggacatcacctccatcgaagtcgccgacaccggctactgcgtggtccagttcctgggccggaagaaagatgacaacagctatcagaccctgacctaccgcaacatcgaggtcctggctgagaccacccccagcgaggacgagaacggcaccgacctgcccaccgacgagcagctggccgccgccaagaccaaggccgacgacctgctggaccagtggaagaacggcgacgccaccgctgattccttcggtgaactggccaagaccaacagcgccgacgagaccaacaaggacaacggcggcctgaacgaggacgccaaccgctccagcctggacgccaacctgaccgactggctcttcgccgaaggccgccagcccggcgacgccgccgtcgtcgaggcctccgacagctccggcaacgtcatcggctatcagatcctgtacgtcgagtccctgggcgagatccagtggaagtatcaggccaccaccgccctgcgctccgacgactatgacaagtggtacaccgaggtcgaagccaactaccccgccgagctgaccgacctgggcaaagagatcgccgccagctccagcaaccagtaa

SEQ ID NO: 2755 - DNA, 1563 bp, Unknown
  Description of Unknown: Firmicutes sequence
gtgcaagcgttgcaaccaacgaaccgaccggtcaacgccgtagagctgcgggacgtgaccaagacctttggcaaggtcgtggccaacgaccacgtgagcctggacatccgcaagggcgagatcctctccctgctgggcgaaaacggcagcggcaagaccacactcatgaacatgctggcgggcatctacttccccgacagcggacagatcctggtggacggcaaggaagtctccatccgctccccgaaggactccttcgccctgcatatcggcatgatccaccagcactttaagctggtcgatgtgttctccgccgcggagaacatcgtgctgggcctgaaggacaagggcaagttcgaccggaaagccatctcccagcagatccgggacatcagcagcaagtacggcttcgatttagacccggacaagaagatctacgacatggccgtctccgagaagcagacggtggagatcatcaaggtcctctaccggggcgcggatattctcatcctggacgagcccaccgccgtgctgaccccccaggagacggagaagctcttctccgtgctacggaacatgcgggccgacgggaagtccatcgtcatcatcacccacaagctcaacgaggtcatggccatttccgaccgggtctccgtgctgcgcaagggccagtttatcgccacggtgaacaccagccagaccagcccccagcagctgaccgacatgatggtcggccacgccgtcaccctgaacatcgaccgccccgaaccaaaggacccacaggaccgcctggaggtcaaggggctgacctgtctcgacggtcagggcgtaaaggtcctggacgacgtgagcttcgccgccaagagcggggaaattctcggcattgccggcatcgccggcagcggccagcgggagctgtgcgaggccattgcgggcctgtatcccgtctcccacggcgagatcatttaccacaaccgccacgacgagcaagcggaggatctcgtgggcaagtcccccctggccattcgcaacctgggcatctccctggccttcgtgccggaggaccggctgggcatgggcctcgtcggctccatgggcatgacggggaacatgatgctgaaaagctatgacaagggcaacggcttcttcaccgacgccaagcccccccgcaccctggcccaggagatcaaagaaaagctggaggtcgtgacccccagcatcaacacccccgtgcgcaagctctccggcggcaacgtccagaaggtcctggtgggccgggagatcgcctccggccccgccgttctcatggcggcctatcccgtccgcggcctggacatccactcctcctacaccatctatcgcctgctcaacgagcagaaagagaagggtgtggccgtcatctatgtcggcgaggacctggacgtcttactggagctgtgcgaccgcatcctggtcctctgcggcggcaaagtcagcggcatcgtggacggccgcacgatcacaaaagaagaagtgggcttcctgatgacgacccacaagggagaggggcgcggccatgactga

SEQ ID NO: 2756 - DNA, 1341 bp, Unknown
  Description of Unknown: Firmicutes sequence
atgtcagaagaagtcctaccacgaaagctgcgtctttcctcctttcaaatcattatcttagggtttgccggcgtcatcctggtgggtgcgttgttgctgatgctgccgctcgcatcggcggagggctgcgtgacgccgtttcctaaaacactttttacggcaacctctgccgtctgcgtgaccgggcttgtggtcgaagacacgggcagctattggtctgtctttgggcaggccatcctcttggtgctcattcaggtcggtggtcttggcgttgtcacggtagccgtcttttttgtcatgctgtctaagcgaaaaatttcgctgatgcagcgaagcaccatgcaggatgccatttctgcgccgaaggtcggcgggatcgtccggctgacgaaattctttctccgtggaacttttttgatcgagctgctgggcgcccttgtcatgctgccggtgttttgccgggactacgggtggtccggtgtgtggatggcggtgtttcattctgtctctgcgttctgcaacgccggctttgatctcttggggcagagcggcagcccctacccttcgctgaccggatacgcagcagacccggtgatcaacctcacgatcatgctgctgatcgtgctgggcggcatcggatttttgacctgggatgacgtttgggagaatcgtctgcacatccgccgctatcggatgcaaagcaaggtcatcctggtcacaacgttatgcctgatcctcctgccagcgctctttttcttcctggcggactattccgcgcttcccatcgggaaacggctcctggcttcctttttccaggcagtttccccgaggacggccggctttaacaccatggatcttactgcaatgacagaagcgtctcgggccattatgatcttactgatgctggttggcggctcgccaggctctaccgcaggcggaatgaaaacgactaccttggcggttctgcttgccaacgccgttgcgaccttccgccgccgggagagcccgcagttttttggacgcagagtcggctctggggccgtcaaaacggctgcaacgatcttgagcatgtatctcatgctattctttggctgcgggctatttatcagcatttatgaggccctgccgctgtctacctgcctgtatgaaacggcgtctgccgtggggaccgtgggcttgacgctgggcatcacgccccagctccatctcccctctcagctgcttttgatcctcctgatgtatttaggcagggtaggcggtctgaccctggtctacgcagcgatgtccagccgggagccgagcgttgcaaaactaccgctggaaaaaatcaccgtcggatga

SEQ ID NO: 2757 - DNA, 2475 bp, Unknown
  Description of Unknown: Firmicutes sequence
atgaaaaaagtgaaagacaccagaccctttaagagtatggacgcgaacaccgccgccggccacgtcgcctatgcttttactgaggtagccgctatttaccccatcaccccctcttcccccatggcagagcacgtggacgaatgggccaaccaagatagaagaaacatcttcggcaaccgcgtgaacatcgtggagatggaatctgaggccggcgctgccggtgccgtccatggctccctgtccaccggcgccctgaccaccaccttcaccgcctctcagggcctgatgctgatgatccccaacctgtataagatcgctggcgagggcctgcccggcgtgttccacgtcgcagcccgtaccctgaccacccacgccctgtccatcttcggtgaccatcaggacgtgatggcctgccgcggcaccggtatggcaatgctggcctccggtaccccccaggaggtcatggacctggctcctgtttcccacctgtccgccatcgagggcagcatgggcttcatcaacttcttcgacggcttccgtacctcccacgagatccagaagctgcgtacctgggactatgagaccctgaagggcatggtcaactgggatgccgtggataagttccacgccgaggccaacctgccccaccacccctatcaccgcggctccaacgagccccccgaaaccttcttccagcaccgcgaggcttccaacctgacctacgacaagctggtcgacatcgtggtcggcaacatgaacaaggtcaacgaggccatcggcaccaactacaagcccttcaactactacggtgcgcccgacgccaccgacgtggtcgtggctatgggttccgtctgcggcaccctggaggaagtcgtggacgtgatgaccgccaagggcgccaaggtcggcgtgctggaggtccacctgtatcgtcccttctccgccaagcacatgctctctgagctgcccaagtccgtccagcgcatcgctgttctggaccgcaccaaggagcccggtgcattcggcgagcctctgtatctggacgttaccgctgtgctggacgacgccggcatgaaggatatccgcgtcatcggcggccggtatggcctgtcctccaaggacaccacccccgctgacatgtactccgtgttccagcacctggccaagggcggccacaaccacttcaccgtgagcatcgtggacgacgtgacccacctgtccatcgagaagtgcgagttcgagctgccccacgatcccacccaggcttccgttaagttctggggcatcggttccgacggtctggtcggcgcttccaagaacacctccaaaatcatcggcgaccacaccgacaagtatgttcaggcatacttccagtatgactccaagaagtccggcggcctgaccatcagccacctgcgctttggtgacaagcccatccgttcttcttactatgtcggcgctgctgactgtgtggtcgtgggtaaccccgcctacatcggcaagtatgacatggtccgcgacgtcaagcccggcggtatcttcatgattaactgcgactgggaaggcgaagagctggaagcccgtctgcccgccgacatcaagcgtgccatcgccaagaagaagatcaagctgtacaccgtcgatgccgtgaacatcgcccgcagcattggtctgaagggccggatcaacaccatcatccagtccgcttacttcaagctggctgatctgatccccgctgaggatgccatcgagtacatgaagcagggtatcatcaacgactatgccgccaagggccagaacatcgttgacatgaacgtggccgccgtcatggccggccagaccgctgccaaggaagtcaaggtccccgcaagctgggccgacgctgtggacggcgagaagcctgagctgaagctcaacaccgtgaacgcagagcaggatgcttacgtccgcaacatcctcattcccaccaacaatctggaaggcgacgccctgcccgtctccgccttcctgccctatgccaccggtaaagttccctccggtaccgctgccttcgagaagcgcggcatcgccgtggacatccccgtctggcacgccgagaactgcacccagtgtaactggtgctccaccgtctgcccccacgctgtcatccgtccttacattctgaaggaagaggatgctgagggcctgaccaccgtggactgcaagaccgctccaggcaagaagttcttcatcggcgtctccgctgaggactgcaccggctgcggctcctgcgtggagatgtgccccgcccgcggcaaggctctgtctatggagcgctccgctggccgtatgttccaggatcaggagaacttcgagtacgccaagaagaagggcgtgcagcagggctctgacaagaccgtcaaggaagcccagttcctgcgtccctatctggagtattccggcgcttgccccggctgcggcgagacgccttatgcc

SEQ ID NO: 2758 - DNA, 1215 bp, Unknown
  Description of Unknown: Firmicutes sequence
atgagcattattttgaccccctttgccaagctgcttctgctgttctacaacatcaccggcagctatggtgtgtccatcatcctgttcggcctggtggtccgtctggtcctgtcccccatcttcctgaaaggtcgtaagggcatgctggccatgagcggactggcggaaaagcagaaggtcttggcccagaagtacgcccgcgaccgggaaaagtacagccaggagctcaccaagctctatgagcaggagggcgtgaagccctcgtccggctgtctttggtccttcctgcccctgcccttcctgatggtgctgtacgccatcatccggcagcccctgacctacctcatgaacgtcacggaggatcagttcaacgtgatctccaacctgctctacggggaggtcctcaactacaagaaccagcagctgcagatcgcccaggatgtgttcctgaaccacgataagatcgtcgccgctgtgcccgacctggccgggatgccccagatcgactttaccttcctgggcgtgaacctgtcccagacccccagctttatgttctggaaagcggatgacgtgggctctgccttcgttctctggctcatccccatcatctctgccctgctgggcgtggtgtccatgatcgtgaccaataagatcaacgccgacgtgcttggcacggccaagcccatggaccagtccaccaagaccaccatgctcatcatgcccctgttctccctgtggatctgcttcacgctgcccgccgccctgggtgtgtactggatcgcaaacagcctgtttgccatgctccaggaagtggtgaacatccccttcctccgttccttcctgaaaaaacaggaaaaggaccgggccgagcgccaggaacaggagcgagagcgcatcaagctggagaaaaaagcccaggccgaagccaagcgcaaggcccaggaggagatgcgcaagatccagatggagcgcaagctcaacaagagcatcgccggggccagccgggagggcatccgcgcctacgccagaggccgtctgtatgacccggagcgctaccccaccttcccctatcaggaccccaacgagctggccaaacaggccgaggccgagcaggcccaaaagcaggccgtggagctggcaaaaaaagacaagaagaaggggaaacccacagcccaggctctggatgagacccgcggcgacaacgacgaaaagtaa

SEQ ID NO: 2759 - DNA, 1158 bp, Unknown
  Description of Unknown: Firmicutes sequence
ggcacccccgcagataccagcggaggcaacagcactgcagacaacggttctgctgcttccggtgacaccgtggtcatcggtgtctttgaacccctctccggcgacaacggcgctggcggcaagcaggaggtcctgggtatgcagtacgcaaactctgtcactcctaccgtggagatcggcggtaagacttacaacgtgaagctggaggtcgtggataatgagtcctccaacgacaaggctgtgaccgctgccggcactctgatttccaaaggtgcttctgtggttctgggttcctatggttccggcgtgtctatcgctgcttccgacacctttgctcagggtggtgtgcccgccatcggcgtgacctgcaccaatccccaggtcactgagggaaatgaccattacttccgtatcgctttcctggatcccttccagggcactgttctggcaaactttgcccatgacgagctaaatgcaaagactgtttactgcctgggtcagttgggtaatgactatgaccagggcctggtcaactacttcaagcaggctgcagagaagatgggcatgaccgttatcaccgactccttccccaagaacaactctgactttacctcttacctgaccaacgccaagaacaagggcgctgacgttatcttcgcccccacctccatcagctatgctcagctgatcgtggagcaggctgctgcacagggcatcaccatgcctttgattgcttctgacacctgggactccaatgtgatcttgggcgcagctaagggcaaaaacgtgcagatttatgtttccaccttctatgctgagggcggtgaccctgacttcgagaagggcttcaaggagtggatcaacgctgactccaccaacttggccaacaatggcggcaacgacatcgtggcagctgtgtccgtcatgggttacgatgcttattacaccgcactggaagcactgaaggctgctggatctaccgagcctgctgctgtgaaggcagcgttgcctaatgtgaagtacactggcatcaccggtgagattgctttcaacgagactggcgatgctatccgcgacagtgctttcattaagactgcaaacaccgaaactggtctgtgggacttcgtcacggttcagggtgttcaggacgctcagtaa

SEQ ID NO: 2760 - DNA, 1512 bp, Unknown
  Description of Unknown: Firmicutes sequence
agccccttctacaacaccgcctgggccctgctgcccccggtgatcgccattgccctggccctcatcacgaaggaggtctattcctccctcttcatcggcatcctggtcggcggcctgctctactcgaacttcagcttcgagggcaccctgacccatgtctttgaggatggcatcgttggctccctggccgacagctacaacgtcggtatcctcatcttcctggtgatcctgggggcgatggtgtgcctcatgaaccgggcgggcggctcggcggcctttggccggtgggcccaaagccacatcaagtcccgcgtgggggcccagctcatcacggtcctgctgggtgttttgatcttcattgacgactactttaactgcctgaccgtgggcagcgtcatgcggcctgtgaccgacaagtacaaggtctcccgcgccaagcttgcctatatcatcgattccacggcggcccccatctgcatcatcgcccccatttcctcctgggccgctgccgttgcgggctttgcggaggacgggcagggcctgaacctcttcatcaaggccattccctttaacttctacgccctgctgaccatcctgatgctggtcttcatctccattctgaagctggactacggccccatggcccgccacgagcgcaacgccatggagaccggcgacctcttctccggcaagaacccctacggctccatggaagaggaggagagctcccccaacggccgggtgctggacctggtcttccccatcctggtgctgatcgtctgctgcatcaccggcatgatctactccggcggcttctttgacggggtgggcttcgtggaggccttctccaactccgatgcctccgtcggcctgatgctgggctctgcggtggccttcatcatcaccctggtctacttcgccatccgccgctccatgcccttcagcgccatgatgagctccattccggagggcttcaaggccatggtgcccgccattttgatcctgactttcgcctggagcctcaagggcatgaccgactctctgggcgccaagtattttgtgcgcgacttcgtgtatcagaacgcctccaacttccagagcttcctgcctgccatcgtcttcatcatcggctgcctgctggccttcgccaccggcaccagctggggcaccttcggcatgctcatccccatcgtccagaacgtcttccccatggacaaccccctggccgtggtgtgtatctccgcctgcatggccggcgccgtctgcggcgaccactgctcgcccatctccgacaccaccatcatggcctccgccggcgctcagtgtgaccacgtgaaccacgtctccacccagttgccctacgccatcaccgtggcggcggtgagctttgtgagctatctcatcgccggcttcgtccccaaggcgtatatctccctgcccatcgccctggtgctgatgctgctcaccatcttcgtcctgcaccgcaccctgaaggggaaggctgcggcctaa

SEQ ID NO: 2761 - DNA, 1503 bp, Unknown
  Description of Unknown: Firmicutes sequence
aagcagccagagacggcgcagttgcaggatgcgctccttgacaagctggtacgtctggcccaggcgtgcgagcggaagggctggcggccggatgaggtgacggagttgctcacagacggtctctttatcacgctgaccaacgtgaattttgacgatggggccattcgtgcgttcacccagcgcatcgacgagatgctggcctgggtggacgcaccgaagccggagaaagaccccggctggctttggcggggggagacggatctggtctccctgcgctccacgctgctctttggcctcaaaggcatggcagcttacgctcaccacgccagagagctgggctataccgacagcgcagtggacacctggttttacaagggccttacgtcgctggcccagccccacagcgtcgaggaatggctggaactcatcttggagtttggccgggtcaatttccaatgtatggccctgttggatcaggcccacacggagacgttcggacatcccgtccccacgcgggtgaacacggacattcagaaggggccgttcatcgtcgttaccggccacgatctgaaggacctccggcagctcttgaagcagaccgccgggaagggcgtcaacgtctacacccacggggaaatgctgcccgcccacggctacccggagctgaaaaaatacacccatctggtgggccacttcggcacggcttggcagaaccagcaaacggaatttgcagacctgcccgctccggtcctgtttacgaccaactgcctcatgccgccccgccccagctacgccgaccgtatctatacgacctccgtcgtgggctacgagggcattccccatatcccggcggacgaaaacgggcataaggattttacacccctcatccaacaggccctttccctgggtggttatgagaccgaccagagccggggcgggctgaatggcggtcacatgctgaccaccggctttgcccgaaatgccgtcctgagtcaggctccagccattctgaacgccatcaaaagcggagcgatcaagcacatcttcctggtgggcggctgcgacggggcgcatccgggcagaaattattacacggagtttgtcaagcgcacacccatggattccctggtcctgaccctggcctgcggcaagtttcgtttcaacgacttggacctgggggagatccacggcatcccacgcatcttagacatcggccagtgcaacgacgcatacagcgccgttcagatcgccttggcgctggcagaggcgtttgactgctccatcaacgacctgcccctgaccttggtgctgtcctggtatgagcagaaggccgtctgtatcctgctgtccctgctggcgctgggcgtcaagaatatctacctcggtccgacgctcccggcgtttctgtccgagcctgtggtgaagatgctggtggatgcctttggcttacagcccaccacccatcctcaacaggatctggacgccatcttacagcgaggataa

SEQ ID NO: 2762 - DNA, 2814 bp, Unknown
  Description of Unknown: Firmicutes sequence
atgaaatcgtttctgcgccgcgctgccgccctgatcctgggggccgcgaccctgtgctcctcggccctggcttcggaagccctgggcagccgtatctattcctacaccttagacatctgcgaccggaccaccctgacccgcgaggtcatgtggtcggcctctaagtccgacctgcggacggaaaactatgtgacctacaccccctcttccagcgtctcccccgtggtgagctacggctccaacgtggtggacaagcagacggtctactccatggccaagggcctggagcggggcggggaacgggtcctcagcggcatcaacggcgattacttcgtcatggccaccggcgaccccctggggctcgtggtgacggacggcgtgctgcgctcctccgcctcttacttaaacgccctgggcttcaatgccgacggctccgccgtcatcggcacgcctaacctctccctcatggcggccttcaagggcaacaacctgaagatcgcggacatcaacaagatccgcaccgccaacggcttctacctcttcaccgacgacttcgcctccaccaccaaaaacacccaggcaggcgtggacgtgatcctggcccccaacaccgagggccaggagctgaagatcggcaccaccgtctcctgcaccgtagaggaggtcattgaggccaaaggggccaccagcatcccccagggcaagttcgtcatgtccatctcgaacaaggccggggaatggctgcaagagaccatccgctctctggaagtgggcgatacagtcgacctgtccatctccagcgaggacacccgctggaacaaggtggtcgacgccgtgggtgccatgcattggatcctgagggacggcatcgtcgattcctccatctccgacggcaccgccgctccccgcaccgccgtgggcgtgaagcccgacggcagcgtgatcttctacaccatcgacggccgccagaagggcctgagcatcggggccaccatccagatggtcgcccaacgcctgaaggaactgggctgccagaacgctgtcctgctggacggcggcggctcgaccaccctggtctccacctatcctgactacggcacgtcctccagcgtaaacagcccctcggaggggacccctcgctcggtctccaacgccatcttcctggtctccaacctgaaggccaccggcaaggccggctccctctacgtcacgcccaaaagcctgaccctgatgcccggcgcttccacccagtgcgtggccaccgccgtggacaccggctggtggcccatgagcagcctgcccggcgccgtcacctggtccgccgccgaaggctccgtgaccacagacggcaccttcaccgccccgcagaaggccggggtctacaccgtgaccgccgagagcggcggcgtgaagggcagcacaaacatcaccgtcttgcagcccaccgccatttacgtcaccaaccaagccaccaagaaaaacgtctccaccctgaccctcgcccccggccagagcgtggacctggctgccgccgcggcctaccgctccgttggcctcaccggcagcgacagctgcttcacctggacggcagacgaggccatcggcagcatcacccaggacggcaaattcaccgccgggcccaacaccgccaccggcaagatcaaggtctcctccggcagctacgccgtgaccatcgctgtctccgtcagcgcccccacccgctacaccctgctggacggcttcgagggcaccacccccggcttcaccgccaagggcggcaccgtcagcttggacaccgcccaggtcaaatacggcaagcagagcctcaagctggcctatcaggacggggcttctgtggccctctcctccccccgcacgctggctgagacggaccgctacgtctccctgtgggtctacggcgatcagtccggttccatcgtctccgctgccttcgcctatgccgacggcacccccgtcacccagtcgctgaccaccctgagcttctccggctggaagcaggtcaccgccgccgtaccggaaaacgccacgacctttaccggtttctccgtggccgcctcgaagcacggcaccacctggctggaccaagtggtcttctccaacgaagcccagtgggacagcaccgctccctcggtggacctcacggtccgggggcagactgtcacggccacgaccctggatgatatttccggctccctcaccgccaagcagatcagcctgaccctggacggccagcccgtggacttcacctggaaggccaacgggaccttgagcgccaccctgcccgccctgggcaccagcagccaccaggtcagcctgactgtctccgacgcctgcggcaacctggcccggaagagcgtcacgatctccggcaccgccgccacccgcttcgccgatatgcagaagcactgggccagcacctacaccacccccctgaacgacaagggcatcatctccggagtcacggcaaacggaaagaccaacttcctgcctgaccagaagatcacccgcggcgacttcgccctgatgacggccaactggctgggcctggacttgagccgctatgccggcgtctccctgccctatgccgacgccgcctccatccccaagtgggatgagaacgccgtgaaagccctctatgccgagggcatcatgcagggcagcaaagccggtgacggcagcctgcgggccaacgccaaggcctccatcacccgcgccgaggccatgaccattttgggccgcatcctgccccagggctacccccaggccagcctcaccgctttctcggacgccgct

SEQ ID NO: 2763 - DNA, 1590 bp, Unknown
  Description of Unknown: Firmicutes sequence
gaggaggaaaaggcccgcgtcaccgcccaggccgccgaggccgccagccaggccaagagccagttcttggccaacatgagccatgacatccgcacccccctcaacgcgattttgggcatgtccgagctgggcctgcgggaggacgcgagcgagtccaaggacaactgcttccgggacatccgcagcagcggccgcattctgctggacaacatcaacagcatcctagacctgtccaagatcgaggcgggcaagatggagatctcccaggagagctatcacatccactcgcccttccacgatgtggtgacgatcctgcggatgcgtgcccaagaaaaaaagctggactttcacgcccagctggatgagaatattccgacgacgctctacggcgacgacgtgaacatcagtcatattgtgatgaacctgggcggcaacgccatcaagtacaccaaggagggctccatcaccctctccgtcacctgggagccccagggggaggacggtgtactggtcatccacatggaggataccggcgtgggcatccgcaaggaggacctgccctacatcttccagagctacggccgcctggaccgcaaggccaaccggcacatcgagggcaccggcctgggcctgcccatctgccagaagctcacggagctgatgcacggcgagctgggcgtggacagcacctacggcgtgggcagcaacttctgggtgcgcctgccccagaaagtcatcgaccccaccccctgcggcccctattgcagcgaggagcagcggtcggacaccggcagctacaactccttcaccgcccccgaagcggtggtcctggtggtggatgaccagcccctgaacctgaaggtctgccagggtctgcttggcccctatgagatggaggtctacaccgcccgctccggcccggaggctctgcggcagatgacccaggtctggcctgacctggtcctcatggaccacatgatgccggacatggacggcgtggagaccacccagcatatccgggagatgggcaagaaagacccctatttcgccgtggtgcccatcatcgccctgaccgccaacgccatgaagggcgtgcgggaggagtttctccgcagcggcttcaacgactttttgcccaagcccatcgagctggacaagctggacaacaccctccgcgcctgggtgccggaggacaagcagaaggcccccgtcattcccctgggcactctgccgggggaagagctgccggaggacctgcaaaacctgcccggcatcgacgtggtccggggcatgtcctactgcggcacgggggacgcctaccgcaagaccctcttcctcttccgggaacagatccccggctacctccgccgcatccggcaggactgggaggaggagaagtgggaggattacagcatcgaggtccacagcctgaaaagcgccgcccgctggatcggagccatggacctgggcgacgacgccgagaccctggaaatggccgggcggggcggggacctggaaaaagtcaacgcccggacggaggacctgctggagcagtgtcagaagctgggggatgcgctggcgttcctgtga

SEQ ID NO: 2764 - DNA, 1248 bp, Unknown
  Description of Unknown: Firmicutes sequence
caataccccaacaaccagcagctgcaaacgctgatgcggcaggccttcctggacgtggtcctggaggaagacaagaccgtgggcggaaacctcaaccgcctgctgaacaaggccgtctatctggtggcctggatgaagcgataccagaaagacctgttccagaactggcaggccccggaggtcggcgtcttcatcctctttggcgcttgctccggggacaacgaggcgctcttcctgcgcctgctggcgaagctgccggtggatgtactggttttgctgccggatctcaacgccccctgcgtgctgaaggacccggcgctgctggacctgcacaaggaacattccctgcccatgaccgactttcccgtggagccctcccagatgcgggtccgcacggcggcctaccaggccgagcgggagatggacagcatcctctatcaaaacaccggcctctaccgggccaagcagcaccagaaggccgagaccgtgaccttgcagaccatgtacgaggagatcggcctgctctgggaccaggagctgaaataccgccccggctttgccgccgagggggacacggtgacggtcccggtcctgctggaaaagatctgcggcatcaaggacgggccgatcctgccatactggctggacatcaagaagctggtcacgccggagacgacgctggtcacgaagcttccctggcagacggggctggaggccaaccccatgaagccctacgccacgcagtttttgcggcagggccgactccagcgggagaagatcaagcagcacaaagactatccctacggcattttgcggccggagatccaagactacctgctggacaagctgcaagttctgctggacgagaagctcatcgccggaacgtatcagaacggcacggagtacaccatcgtctcgacgatcctgggcctgccgaaggacctgctgcggcgcatccagaacttcgactttaccaagaaaaaccccaagctcatcatcatcagcaccacagaggaaacgctgtcgctggaggacagcatcttagtggcgtttctgaatttggtggggttcgacatcctattcttcgtccccacgggataccaaagcatcgagaaatacttccaaaagccgtttgccaacgagcatcaattgggcccctaccgctatgacctgcaggtgcctgattttcggaccctgcatgagggaggaaaaagctcgatcagaaaattattcggaaggagtttttaa

SEQ ID NO: 2765 - DNA, 1608 bp, Unknown
  Description of Unknown: Firmicutes sequence
cgctatttttgttgtaacgccgcggtatatgcggcggaaggagaagttgaaatgaaaaaacgtattttcgcacttttcctgtcggtcctgctcttggcaactgtactctgcgcctgcggagacacgaagcaagaagaggcgggcggggtcggcagcgacggaaccagctcttccggagcagtggtcgatggcggtgaaatggtcgtcggcattgcacaagacctgggagacagtcttgacccgtatcagatgacggcagcaggaaccagagaggtcttatttaacatctatgaaggcctggtcaagcccaacgccagcggcgagtatgtgcccgctgtggcttccgacagcaccgtgtcggaggatggcctgacctataccttccccctgcgggagggcgtgctgttccacaacggcgcagccgtcaccaccgatgatgtgatctattccttcaaaacctgcgccgagaccacggtagacactgccctggccgaggcgctttcttctgtgaaagatattacggcggacggcaacaccgtgaccgtcaccctgaaggaagccaaccccgacttcctgtcctatgtgggcatggtgtatatcgtcccggcggactacaccgacgaggccaccgcccccgtgggcaccggccccttcaagttcgtctcccgctccgtccaggagaacctgatcgtggagaagttcgccgactactggggcgagaaggcccacctggacaaggtcaccttcaagatctatgaggacgccaacgccctcatgtctgccctgagcgcaggctctgtggacatggccgtgcacctgaccatcgaccaggtggacaccatcggcaccggcacctacaagaccctggagggcaccatgaacctggtccaggccctctacctgaacaacgacgtgaagcccttcgacaacgagaaggtccgccaggccatgtgctatgccgtgaacgtggacgagatcctcgacctgaccagcgagggccacggcaccaagatcggcacctccatctatcctgccttcaccaagtactttgacgcaagcctggccgacgcctatccctacgacgtggacaaggccaagcagctgctggctgacgccgggtatgctgatgggttctccatgagcatcaccgtgccctccaactacaccccccacatgaacgtggcccaggtgctggtggagcagctggccaaggtcggcatcaccgccaccatcaagcccgtggagtgggagacctgggtctccgacacctacaccaaccgcaactttgagagcacggtcatcggcttcgatgccgccaccctcagcgcgggcgctctgctcaaccgctggatgagcgacaacgacaagaacatgatcaactacaataaccctgagtacgacaaggtcatgcaggaggccaatgcgtccaccgacgacgcaaaacagaccgagctgtacaagcaggctgccgccatgctgtccgagacggctgccaacgtgtacatccaggacctggcggacttcgtgctcctcaagaacaacctggacggctaccagttctatcccctgtacgtgatggatctgtccaccgttcactatgtccagtaa

SEQ ID NO: 2766 - DNA, 1389 bp, Unknown
  Description of Unknown: Firmicutes sequence
atggtattttctagcttacccttcctgcttttgttcctgctggtggtcctgctggtcagccacatcctacccttcaagttcaggaacttcttccttctgctggccaacctggtcttctatgcctacggtgagccggtctatgttctgatcatgatcgggtccatcctggtcaactacttcggcggcgtcctcatcgaaaagcagcccacccggacccgcaagcgtgtcgttctgatcctcggcatcgtcattgacctggcggccctgggcgtgttcaagtatgcgggcctgttcgtcgggacgctcaagcagatcccggccttctccggcctgccggacgtgagcatcgccctgcccatcggcatctccttctacaccttccaggccgtgtcctacctcatcgacgtgtattgggacgactgcgaggcctcccacagcctggtgaacttcgcctgctacatctccctcttcccgcagctcatcgccggtcccatcgtccgctacaaggacgtgaacgaccagctcatctcccgccacgagacgcccaccctgttcaactccggcgtgcgcctgttcatggtcggtatggcgaagaaggtcctgctggccaaccagttcggcatgctctgggacaccatgtccgccgaccccgtggccgccgggatgctgggggcctgggcgggggcctgcgcctataccctgcaaatctacttcgacttcgccggttactccgacatggcccgcggcctgggccggatgctgggcttcgagttctgcatcaacttcgattacccctatatctccaagagcgtgaccgagttctggcggcgctggcacatctccctgtccacctggttccgggattacgtctacatccccctgggcggcaaccgctgcgggaaaatccgccagtgcgtgaatattctcatcgtctgggcgctcacgggcttctggcacggggccggctggaacttcctcttctgggggttctattacggcgtgctcctgctcatcgagaaattggtcctgggcaagtatatcaagcgcctgcccgccgtcttccagcatctctacgccatggtcatcgtgatcatcgggtgggtcttcttcgcctccccgaatctctccaccgccctggcctacctcaaggtcatgttcaccggcggcgcggggaccatgggcggggccaacgccgtgctgccctgggtggggatgttcctgctgggcgtggtcggctcgacccccctggccaagaaggtctgggacaagctggagggcaaaaaggccatgcccctggccgagggcgtcctctgtctggccggtctgctgctgtgcatcgcgagcctcgtcagcagcagctacaaccccttcctgtatttccgtttctaa

SEQ ID NO: 2767 - DNA, 1893 bp, Unknown
  Description of Unknown: Firmicutes sequence
atggcaaagaacaaagattaccgaccggaggacatcgccttccctgaccaggtcattgtcgagtccgagctggtcaaggagatgaaggacagctacatcgactatgctgtttccgtcatcgtgggccgtgccctgccggacgtgcgggacggcctgaagcccgtccaccggcggatcttatattccatgtacgagagcggactgacctgggacaagcctttcaaaaagtccgccacctgcgtgggcgacgtgctgggcaaatatcacccccacggcgacgcgtcggtctacgacgccctggtccgtctggcccaggatttctccatgcgctaccggctcatcgacggccacggcaacttcggctccgtggacggcgacccccccgcagcctaccgttacacggaggcccgcatggccaaaatggccggggatatgctggcagacatcgagaaggacaccgtggattggtcccccaacttcgacgagagccgcaaggagcccaaggtcctgcccgcccgcttccccaacctgctggtgaacggctcttcgggcatcgccgtgggcatggccacgaacatcccgccccacaacctgcgggaggtcatcgacgccgctgtctgcgtgctggaaaacccggaggccgacctggccgatctcatgcagtacatcaagggcccggattttcccaccaagggcatcatcatgggccgggccggcatccgcgctgcctacgccaccggccggggccgagtgaccatccgcgcccgcaccgagtttgaggagtacggccggaaccacgaccgcacccgcatcatcgtcacggagctgccgtaccaggtcaacaagcggatgctcatcgccgccatcgccgagcaggtgaaggaaaagcggctggagggcatctccgacctgcgggacgagtccgaccgcaacggtatgcggatcgtcattgagctgaaacatgacgccaacccccaagtggtcttgaaccacctgctgacccagacccagttacagaccaccttcgccatcaacatgctggccctggtggacaaccagcggcagccgagagtcctgtccctgcggaacattctggacgagtatctgaccttccaggaggaggtcatcacccgccggaccctgttcgacaagcgcaaggccgaggaacgggcccatctgctggagggtctgctcatcgcccaggacaacatcgacgaagtgatccggatcatccggtccagctatgacaacgccagagaaaacctgatgaaccgcttcgacctggacgaggttcaggcccaggccatctgcgacatgcggctcatcgccctccagggtctgaaccgggaaaagctccagaacgagtacaacgagctggagaaaaagatcgcctggttccagcagctgctctccaaccgggagctgctgctgggccagatgaaaaaagaactgctggaaattcgggataagtacggcgacgaccgcctgaccgagatccaggacgtggcggacgagatcgacatcgaggacctcatcgaggaggagacctgcgtctttaccctcaccgccgccggctacatcaagcgcatgcccgtctcgacctatcgcgcccagaagcggggcggcaagggcatttccgcccagagcctgcgggaggaggattatgtcgacaccctcttcaccgcctccagccacgacaacatcctcttcttcaccagctccggccgggtctacaagaagaagggctatcaaattcctgaagccagccgcacggccaagggcacccacctgaacaacatcttccagttcgagccgggcgaaaaagtgaccaccatgatccatggccgggattatgacgagaacggctatctcttcatggtcacgaagaacggc

SEQ ID NO: 2768 - DNA, 2124 bp, Unknown
  Description of Unknown: Firmicutes sequence
gaggtgatccggggcctccttcagctccacgaggagacaggcatccccctcgtcgccaccaacgacgcccactacctcacccgccaggacgcggggatccaggacgtgctcatgtgtattcaaatgggccgaacggtagacgaccccacccggatgcggtttgagacccaggaattctatctcaagtccgaggacgaaatggctgccctctttcccgactggccggaggctttggaaaacacggccaagatcgcggaagcgtgcaacgtggacttccagttcggggtctatcacctgccggaattcaagctcccggagggctggacggacggagatgcctactttgaacacctctgccgcacgggcttcgcccgccgttaccccgatggcagcgaggaatatgagaagcaattagactatgagatggccatgatccgccgcatggggttcgtcgaatattttctgatcgtctcggacttcatcggctacgccaagtcccatgacatccccgtggggccggggcgtggctctgccgccgggtcgatggtcgcctactgcatggacatcaccgacgtggaccccatgaaatactccctgtacttcgagcggtttctaaaccctgagcgcgtgtccatgcccgatattgacgtggacttctgctaccgccgccggggagaggtcatcgactatgtgaaccgaaagtacggcagtgaccatgtggcccagatcgtgacctttgggaccatggccgccaagggggccattcgagacgtgggccgggcgctggacgtcccctatgcggacgtggacgccattgccaagcaggtccccaattccctgcacatgacgctgaacaccgcgctcaccctctccaagcccctgcgggagatgtacgagaaggaccccacggtgcagaagatcatcgacacggccaagggcctggagggcatgccccgccatgcctccacccacgccgccggggtggtcatcacccggaacccggtggatacctacgtccccctggcgaaaaatgacgaggccgtggtcacccagtacaccatgaccacgctggaagagctgggcctgttaaaaatggacttcctggccctgcgaaatttaacggtgctggacgacgccattcagatggtccgcacccacaccccggattttgatttacggaccatcccggatgacgacccgcagaccttccagatgctgtccgacggccgcacctgcggcgtgttccagatggaatctgccggcatgaccggcgtgtgcgtgggcctcaagccgaaagatatcgaggatatcacggccatcatcgccctgtaccggccggggccgatggattcgatcccccgcttcattgcgtccaagcatgacccggccagcgtgcgctataagcacccaagcttagagccgatcctctccaacacctacggctgcatcgtctaccaggagcaggtcattgagatcttccggcgcttggccgggtactcgctggggcaggccgacatggtccgccgggccatgtccaagaaaaaactgaaggacatccagcgggaacgggaggccttcctgcacggggacccggagcggaacatcgccgggtgcgccgccaacggcatcccccaggagaccgccgagagcatttacgacgagatcacggactttgccaactacgcctttaataaggcccatgcggtctgctacgccatcgtggcctatcagacggcctggttcaagtgtcactatcccagggagtatatggccgccctcttgacctccgtgctggactctcaggacaagatcgcggagtacatcgccgagtgccgcagcctgggtatccgcctgctgcccccggatgtgaacgaatccggctcggacttcaccgtggccgggcaggacatccgcttcggcctggccgccctcaagggcgtgggccggggcttcaccaagtcaattttaacctgccgagagacggacggcccctttgtatccttcctcgatttctgcaagcggatgctggagcaggacatgaacaagcgaatgctggagagcctcatccgcgcggggggctttgacagcatgggcctgcgccgttcccagctattggacgcctac

SEQ ID NO: 2769 - DNA, 3474 bp, Unknown
  Description of Unknown: Firmicutes sequence
atgagcgaagtacatatcaagaacttcaagcgagttctggtggccaaccgcggtgagatcgccatccgtgttttccgggctctcaacgagctgggcatcacctccgtggccgtctactccaaggaagataagtacgccatgttccgcaccctggccgacgaagcctatgccctgaaccctgagaagggccccgtcgatgcctatctggacatccccaccatcatcaagatcgccaaggaccacaacgtggacgccattcaccccggctacggcttcctggcagagaaccccatcctggtcgaagaatgcaccaagaacggcatcgtcttcatcggccccaccgtggagagcatgaacgccatgggcgacaagatctcctccaagcagatcgccatcgcctctgacgtgcccatcatccccggcgtggaccacgccatcaagaccaccaaggaggccctggaggtcgctgagaaggtcggctatcccgtcatgctgaaggcttccaacggcggcggcggccgcggtatgcggatcgtcaacaaggccgaggacatgcccaaggagttcaaggaggccatcgacgagtccaagaaggccttcggcgacgaccaggtcttcatcgagaagtacctgcgcggccccaagcacgtggaggtccaggtcctggccgataactacggcaacgtggtgcacctgtatgaccgtgactgctccgtgcagcgccgccaccagaaggtggtcgagtacgcacccgccttctccgtgcctcaggcttcccgccagaagatcttcgacagcgccatccgcctgtgcaagcaggtcggctaccgcaacgccggtacctgcgagttcctggtcgacctggacggcaacccctacttcatcgaaatgaacccccggatccaggtcgagcacaccgtcaccgagcttgtcaccgacgtggacatcgtgcgctcccagatcctcatcgcagagggctatcctctgaactccccggagatcaacatcacctcccaggaggccatccagtgccacggctacgccatccagacccgtgtcacctctgaggacccctccaacaacttcatgcccgacaccggcaaggtcagcgtgtaccactccggctccggcaacggcatccgtctcgacggcggcaacatctacaccggcgctgagatcctgccctactacgactccctgctggtcaaggtcagctccttcgaccggaccttcaagggcgctgccaccaagtccctgcgtgctctgcgcgagatgcgcatccagggcatcaagaccaacatctccttcctcatcaacgtggtgaacaaccccaccttccaggccggcaagtgctacaccaccttcatcgaggagacccctgagctcttcaccctgtcccacaacctggaccgggcttccaagatcctggacttcctgggcgacaagatcgtgaacgtctccaagggcgacaagccttacttcgaggaccgcgtgctgcccaagtacaacgagaccgccctcatctacggcgccaaggacgagttcaagaagctgggtgccaagggcttcacccagaagatcctgggcgagaagcgcctgtacatcaccgacacctccatgcgtgacgctcagcagtccctgatcgccacccgcatgcggaccaaggatatcgtcggcgcagcaaaggcctccaacgccatcttccagaacgccttctctgtggaagcctggggcggcgccacttacgacaccgcttaccgtttcctgaaggaatccccctggaagcgtctggagatcctctccgagagaatgcccaacaccctgatccagatgctgctgcgtgcttccaacaccgtcggctacagcagctatcccgataacctggtcaaggagttcatccgcatctccgccatcaagggcgtggacgtcttccgtatcttcgacagtctgaactggatggagagcatgaagatgcccgtcgaggaagccctgaagaccggcaagatcgtcgaaggctccctgtgctacaccggcgacatcaccagccccaaggaagtcaagtacacgctggactactacgtcaagaaggcccacgagctggaggacatgggcgtgcacatcctggccatcaaggacatggccggcctgctgaagccttatgccgccaagctcctggtggagaccctgaagtccgagctgaagatccccgtccacctgcacacccacgacaccaccggtgccggtgtggccaccgtgctgaaggctgccgaggccggcgtggacatcgtcgacctggccatcgagtccatgagctcctgcaccagccagccctccctgaacgtggtcgtcgaggccctgcgcggcaccgagcgcgacaccggcctggacttcgagggtctggacgagctgagccgttactatgagcatgtccgcaaggtctacaagtccaacgagagcggcatggtctcccccaacgcccagatctataagtacgagatccccggcggccagtattctaacctgctggctcaggtcaccgagatgggctccaaggacgagttcgagaagatcaaggacctgtacagccaggcaaaccacctgctgggcaacctgatcaaggtcaccccctcctccaaggtcgtcggcgacctggccatcttcatgctgaagaacggcctgaacaaggacaacatcctcaccgagggcgcttccctgtcctaccccgactccgtcatcgacttcttcaagggcatgatgggccagcctgagggcggcttccctgccgagctgcagaagatcgtcctgaaggacatcgagcccatcaccgtccgccccggcaccctgctgcccgacgtggacttcgaggacatcaagaagcacctgcgcgagaagttcaacatggaaggcttctccgacttcgagatggagcagaaggccgtcagctacgccctgtatcccaaggtctacgaggattactgcacccacttcgaggcttacaacgacgtcaccaccctggagagccacgtctacttctacggcctgcgcaagggtgaggagaccacgctgaaggtcagcgagggccgcaacatcctcatcaagttcgtcggcatgtccgaccccgacaaggacggctaccgcgtcctgaccttcgaggtcaacggcatcctgcgtgagctgaaggtcctggacaagaccctggaggtcctggaagaccgcaagctcaaggccgacaagaacaacccctgccacctgggctccaccatccccggcaccgtggagaccgtcctggtcaaggagggtgacgaggtcaaggtcaaccagcctctgatgatcgtcgaggccatgaagatggagaccaccttcgtctccaaggtcgatggtaaggtcgataagctctatgtggcccccggtgaccgcgtgaacaccgaggacctgctgatctccttcatcctggacgaggacgcagagggctga

SEQ ID NO: 2770 - DNA, 2211 bp, Unknown
  Description of Unknown: Firmicutes sequence
accgaggagtgccagccccggaagtttgacgacgtgctggaccttctcgaacacaccaccaccgtctccgcccccgtggacaccatgcctcccctcttcacctcaaaggaggagtacgaggcgttctcccggcggcaccagtccatgacggtccccacggtggacctccatacttacaccggccccgcttacttaggcatcgacgccggttctacgaccacgaagctcgtcctcatcgacaaggacgacaacattctgtactcgttttaccactccaaccagggaaaccccgtccgcatcgtcctgccccaattaaaagagatctacgcccagtgcggcgaccgcatttctatctgcggggccgccgtcaccggctacggcgaggacctcatcaagaacgccttctcctgtgacctgggcctggtcgaaacggtggcccatctcaacgccgcccgccacttcacccccgacgtggacttcatcatcgacatcggcgggcaggacatgaagtgcttcaagatccgcaatggggcggtcgattcgattttgctcaacgaggcctgctcctccggctgcggctccttcatcgagacctttgccaaggccctgggctattccatcgcagacttttccaagatgggcctctttgccaagcacccggtgaacctcggctcccgttgtaccgtctttatgaattcttccgtgaagcaggcccagaaggacggcgcttcggtcgaagacatctccgctggcctctccatctcggtggtgaaaaacgccatctacaaggtcattcgcgccgccagcgccgacgacctgggcaagcacatcgtcgtgcaaggcggcacgttcctcaacgacgccgttcttcgctccttcgagctggagatcggccgggaagtcacccgcccgacgatttccggcatcatgggcgcttacggcgcggccctggccgcaaaggagcttggcctgcccaagtccgccctgctctccgcgaaggacttagaggagttcacccacgaggcccggcccgccacctgtaagctctgcacgaaccactgctctctgaccatcaaccgcttcaacggcggccgccgcttcatctccggcaaccgctgttcccgtcccctgggccaggagaagatcgacatcccggacctgatgaagttcaagtatcagtatctccgctccctccagggcaagggcggcggtgacggttcccgcggcaagatcggcatccccttcgggctgaacatgtacgagaacctgcccttctggtacaccctctttaccaacctgaacttcgaggtggtcctctcccccgaatccacccggagcctgtacatcaaggggcagcagaccatcccctcggacaccgtctgctaccctgccaagcttctgcacggccacgtcatggccctgctggacgagggcgtggacaccatcttctacccctgtatgtcctacaacttcgacgagcacctggcagacaaccattataactgccccgtcgtcgcctactaccccgacctgctggcagtgaacatctccgccctgtccaaggtcaagtacctccaccccaacctgggcatccaccgcccgaaagattttgagaaaaagggcgccaagctcctggccgacgagttcggcgtgcccaagcgggaggccgtcaaggccatccgcaaggcctacgaagcctaccacggcttccggggcctggtccagcagaagggcgcggagtacatcgactttgcccggaagagcggacgtaagatcctggtggtcgccggccgtccctaccacatggacccggagatcaaccacggcatcaacgacctcatcacgtccttcggcttcgtgctggtgacggaggacgccgtcttccagcacatgggcaaggagcctcgccacgttctgaaccagtggacctatcacgcccgcatgtacaacgccgcccgctacgtctgcacccagccggacatggccttcatccagctggtgtccttcggctgcggcgtggacgccatcacgacggacgagctgcgctccattctagaggaacacggcgagctgtacacccagctcaagatcgacgacatctccaacctgggcgcggtcaagatccgcatccgaagcctcatcgccgccctggacgccagagacgcccaggccaagaaacacgcaccggaaggaggggacgcaaatggctaa

SEQ ID NO: 2771 - DNA, 1368 bp, Unknown
  Description of Unknown: Firmicutes sequence
cctgtggatgaccccatcctggctccctccgtgaactccgtgaagatgacctatgacctggcccaaggccccaactacgcggacctgatgaccgccacctcccacctgaccggcgagaccgtcaaccgcttcatgaacatccaccagtccaccgatgacctggtgaaaaaggtgaagatgcagcgcctgctgggccaggtcaccgccgcctgcttccagcgatgtgtcggcatggacgccatcaacgccgtctattccaccacctatgagatcgaccagaagtacggcagccagtaccacgagaacttcaagaagttcgtcatcgaggcccagagaaaggactggaccatcgacggcgccatgaccgaccccaagggcgaccgcggcctgcccccccacaaacaggaagaccccgacatgttcctgcacgtggtcgagcagcggcccgacggcatcgtggtccgcggggccaaggcccaccagaccggcatgtgcaactcccaccaggtcctggtcatgcccacccaggccatgggtcctgaggacaaggactacgccgtctccttctcctgccccgcagacgccgagggcctgtttatgatcgttggccgccagagctgcgacacccgcaagctggaaggctccgacatcgacgtgggcaacgcccagtacggcggcgtggagctgctggtcgtgtttgacgacgtgttcatccccaacgagaacatctacatgaacggcgagagcgagttcgccaccgtcatggtcgagcgctttgccggctatcaccgtcagtcctacggcggatgtaaggtcggcgtgggcgacgtgctgattggcgctgccgccgtggccgccgactacaacggcgtggccaaggccagccacatcaaggacaagctcatcgagatgatccatctcaacgagaccatgtactcctgcggcatcgcctgctccgccgagggcacccagaccgcctccggcaactacctgatcaatctcctgctggccaacgtctgcaagcagaacgtcacccgcttcccctatgagatggcccgcatcgccgaggacctggccggcggtgccgtgggcacctgcctgtccgaggcggacctgcacggcgagttcaccggtccctgggtcgagaagtatatgaagaacggcaccggcaccaccgccgagaaccgcatgcgtattctccgcctgatcgagaacctctctctgggcgccggggccgtcggctaccggaccgagtccctgcacggggccggctctccccaggcccagcgcgtgatgatcgcccgccagggtgacatcgccggcaagaaggtcctggccaagcgcatcgcccgcgtgaaagaggactga

SEQ ID NO: 2772 - DNA, 2001 bp, Unknown
  Description of Unknown: Firmicutes sequence
atgcgtcagcaaacctttcaaaaagcgctttcccggctgacggacacgggctttcgcctgtttttcgtcactgggttggtctttgccgttctcaccggcctgtataacatttggctctgcatggcggagctggtgatcctcttggtcctgtatctctacttccagtccggcgccatccgccggaagcaggaggcgatggattacctggaccatctggccagcggggtggacaacgcctcccgccggaccatgctctccagccccatgcccatcgccattttccggccggatacggacgacatcatctggagcaacgaacgctttcttcacctcaccggcgacccggaccacctcttcgagacgaagctctccgccctggtccccgcctttcagtcccagtggctgctggacggcgagcacctcagcccggagccggtgcctgtgggagaaaagctctacctggtctacggcaacctggtctgcaccggggagcaggacagctttctggccacgacctattgggtggacgtgacccaatacgcgacagtagccgccaagttcgacgccacccgctccgtcgtgggcatcttacaggtggacaactacgaggacctcagccgaggcctggaggagggcgaacgggccgtgatgcgctctgagctgaacaaccgcctctccgcttggctggacccttcgcaggggcttttatgccgctacgaccgggaccactatctgctgctggtggaggccgcgcagttccaggccttctgccggaagaagttctccctgctggatgagatccgccaggtgcaaagccccaacggggtcgccgccaccctctccatcggcttcggccgcaacggggaaaccccccggcagctccacgaatacgcctccctggcgctggacatggccctcagccggggcggcgaccaagtggtggtcaaagacggcaacgacttttccttcttcggcggccgctcgaaagagaccgagcgccggaccaaggtcaagagccgcgtggtggcttccgccctgtcggagctgctggccagcacccaccaggtcattgtgatggggcacaaataccccgacctggacgtattgggggccgtagccggcgtgtgcgccattgcccgaaaaaaagacgtgcccatcaaggccgttcgcgccccctccccctatccttccgaggagcagacgaagcagctggcctccctgccggagtaccagggcatcttcatcccgccggacgaggccattcgcctggccaagcccaccagcatcgtcgtggtggtggacaccaaccggccggaacagacccaggtgccggagctgctgacctccggggccaggatcgtggtcatcgaccaccaccggcgggcggcttcctacatcgaaaagcccgccctgagcttccacgacccctacgcctcctccgccagcgagctggtggcggagctggtgcagtatattctggacaacggcgacctcaagcgccaggaggccgaggccatgctggccggcatcgtgctggacaccaagaacttcaccatgcgcaccggcagccggacctttgagacggcggccttcctccgcaaggccggggccgacaccgccctggtccacaagttcttccagcatgacctgcgggacaccgtgaccaagatgcagatcatccagggggcccagacctaccgcggctccatggccatcgccctgaccgaccgacctgtgggccgggccattgcagggcaggcggcggacgagatgctgaacatcgccggcatcgaggcttccttcgtgctcttcccggaggcggggcaggcctatctctccgcccggtcggggagcaacgtgaacgtccaggtcatcagcgagatgctgggcggcggcggcaacgccaccaccgccggggcccagttccccggcaagaccacggaggacgtgctgcccctgctgaaagagaccatcgacaattacttcgacgacgagacataa

SEQ ID NO: 2773 - DNA, 1320 bp, Unknown
  Description of Unknown: Firmicutes sequence
atgaagcaactattttacggcggcgtccaccccgccgaacacaaggaagctactgagcagaaaccgatccaaccgctcgccaaagcaccggcccaggtcgtgatcccgatgtctatgcacatcggtgcgccctgtaagcccacggtgcagaagggcgacacggttttggtcggtcagatgatcggtgctaccgcgggtctcggcgctcccatccacgccagtgtttctggcacggttgtggcagtagaaccccgtcccggtaccggaggcgtccctacgctctccgttgtgatcgagaacgacttccaaaacacccttagcccggactgcaagccgcgggaaaatgtggatgccctgagctctcaggagatcatcgacatcatccgcgacgctggctgtaccggtatgggcggcgcgggcttccccacccacgtcaagatcagttccgcagtcggcaaagccgacaccattatcgtcaatggtgctgaatgtgagccctacattaccgctgaccaccgcctgatgcttgagcacggcgagaagatcatcggcggtgttcggttcatcatgaaggcccttcagctcgaccacgcattcatcggcattgaagacaacaagatgaacgccgtgaaccacctgaaggagctggttggcgacgccaaggacatcaccgtccaggcgctccgcacccgttacccccagggcgctgagaagcagctcatccaggccatcaccggccgtgaggtgcctcccggaaagctgcccgccgatgtgggctgctgcgtgttcaacgcagccaccactgctgccatctacgacgctgttgcccttggtcagcccgtctatcagcgggtcatcaccatcaccggcagcgccgtgaagaaccctgtgaacctgctggctcccgttggcacccccttctcccacctcatcgaggaagcaggcggcttcgacggtacccccgcccgcgtcatctccggcggccccatgatgggttttgcccagtatgacctgtccgtcaccatgggtaaggccagcaactgcgtgctctgcctgagcaaggaggatatgcccgctgtcagcgccaatcccacctgcatccgctgcgcacgctgcgtcaatgtctgccccatgcacctgacccccctgttcatgaacatgttcgccaaggcccgccgctggagcgaggtcgaggagtaccggatcatggattgtatggaatgcggcagctgccagtacatctgcccggccagaatccctctggtgcagcagttccgtaccgcaaaatttgccatccgccagcaggcggcaaaaaagtaa

SEQ ID NO: 2774 - DNA, 1356 bp, Unknown
  Description of Unknown: Firmicutes sequence
atggacgaatcctctttacttctccgccagatcccccacagcgtcgaggctgagcagtcggtcctgggggccatgctcatcgacccccgctgcattcccaacgtggtggagcagctcaccggcgaggacttctatctgaagcccaaccgggatatttatgagaccatctacaccatgttcagcttctccgccaccattgacccggtgacggtgctggaccagatgaagctgcggggggtctacgacgagaacaccaccagcaactacctgctccagctcatggagatcacccccaccgccgccaatgtctccgagtacatccgcatcgtcaaggacaaggcgctcctgcgccgcatttccgagacggccggggaactcacgaccctggtccaggaggggggcgagacggcccaggccgtcctcgacctggcagaacagcgcatctatgccatccgccaggggaagtcctcccagggcttggagcctctttccaagatcctggtggatgtgttcgaccggctgcaagagctgtccatgtccggctccgacgtgcccggcatggcaaccggctttgccgacctggaccggaccctcacgggctttcacggctccgagctcatcctattggctgcccggcccggcatgggcaaaacgtcctttgccctgaacgtcctgctccacgcaggcaagttctccggcaagagcgtggtcttcttctccctggaaatgagccgggagcagctggccacccgtctcatctccaacgaggcctttctggacaacaaaaagctgatgacgggcaagctctcccccgacgattgggacagcgtgaccgtggcctccacggccctggcccacacgaaaattttcattgacgacaacccctccctctccgtggcggacatgaacgccaaatgccgccgggtggaggacctggggctggtggtcatcgactacttacagctgatgcagtcctccggcagcggcacccggtacgccggggagaaccgccagcaggtggtggcagacatcagccgttccctgaaaatcatggcaaaggagctccacgttcctattctgtgcttatctcagctttctcgtgccaatgagagccgtacaaataagcgccccatgctctcggacctgcgagagtccggggccattgagcaggatgccgacgtggtcatgttcctgtatcgagacgactattataacaaggacagtgacaagcataatcaggccgagtgcatcatcgccaaaaaccgccggggggagaccaccaccatccccctccagtggctgccggagttcactgccttttcctcaatggagcggaaatatgaagaaccctattga

SEQ ID NO: 2775 - DNA, 1647 bp, Unknown
  Description of Unknown: Firmicutes sequence
atggaacccctctacacccgttacatccaggagaccttcggccccgacggccaggtgacggactggcactaccaatacgaagacaactttaattacgcctatgacatcatcgacaccatggccgccgccgagccatggcgcatggccatgctctggcgcaacgaccgcggcgcagagctcaagctgaccctggaagacctgtccgtgatgagcaatcgcatggcgaacctcttccgcagccacggccttaagcggggcgacgtgatcctcacggccctgcgctcccactggagctggtggatcgtggccctggccgcccacaagctggggctgctcctgacaccctgctcctatctgttgtcggaacaggacttcctctaccgcatgaccaaggccaaggccaagtgcgtggtcacctgccgagagaacggggccgatcggcgcgtcctggctgcggcggaacaggccggggtgtccgtccgcttcgccctggggggcggcagcgggtatctggacctgctggggaacatggacaagcagccgggggtcctcggacgcatccccacctccgccaaagacccgatcctgctgtatttcacctccggcaccaccggccagcccaagggtgtcctgcacgacggcgcttacaccctgagcaactactggggggccaagtatatgcaggatatccacccaggctccctccactttgccaccggcgacaccggctgggaggtggtctgcggcaccaagttctacggccagtggatgctgggcggggcgctgctggtgtatgactacgaccgcttccccccggaaaaagtcctggagacgctgcaggagacaaaagtcaccggcatgatggcccagccgaccgtctaccggatgctgaccaaagtgggcatggacaagtacgatctgtcttccatcaccaactatgcggtcggcggcgagaagctcttgccggacctggcgaaggtggtgcaggagcagacgggacagcccctctacgagggctatgcccagtcggagaccaatctcatcgctgccgcctcgaaagcgtttggccgtcgggaggggtccatggggaaaattttgcccaagtaccacgttgaaattttgaaggaggacggcagctttgccgcgcccggagaagtgggggagatcgtgatcgtcgccgacggcggccagcgccccaacggcatgatgaccggctatctgaacgacgaggaggccacccgccgcctgtgggacggggatattttccacacctgcgacctggggagccgggatgccgacggcttcctcttttaccagggccggaacgactcgatcatcaagaccaaggggtaccgggtcagccccgtggagatcgaagacgccctgtccctccaccctgctgtggcggaatgcctggccgtgggagagccggacccggatctggggcagaaggtgaaggcctacgtccacctgaaccagggctatgcccccggcgatgccttgcgggacgagctgatggccttccacaacgatgcctgcgcgggctttaagaagatccgggagctggaatttgtggggccgctgcgtcggaatcccaacggaaaagtcattcggggacagtttgcgaagaccccaacaaaaatttaa

SEQ ID NO: 2776 - DNA, 525 bp, Unknown
  Description of Unknown: sequence from a bacterial species not precisely identified
acaaaaagcggattgtttatgccgatcaagaagtttaatttcaacggggacgatgtgcttccccgtctgggtgcttttgcgccggccggcgacatcgattttgaaaaaagctatcctgaaggagaaaaggcgagcggacagctttgggcgtcacatccggtgtcgattacgttgggggagaacgggacgtacttcgtcgcagatgccagccgcaacaagatttttggctatgacagcgacggtaatctgttgtatgcctttgccggcacgggatcacagaagggcttgttctcgagtctgacggcgattgaatggcatgacggctgtctgtacgcgctggataaaaaccacagtacgatcacccgttttacccttaccgaatacgggacgatgctgcatgaggccatcggtctgtcggcacatcgccgttttgaggaggcggaggaaagcttccggacgctgctttcctataaccagaatctgacagtggcgtatattgagctgggacgtgcgtgtctggagcag

SEQ ID NO: 2777 - DNA, 1092 bp, Unknown
  Description of Unknown: sequence from a bacterial species not precisely identified
atgaccattacgggcagcacggttgttttgaatagcggccgtgtgggtaccaaaagttcctacaatatgaataacgctaagattgtgtttgacgtcagctatgcggatccgggtcaggcgccgacctccaaaatacaggtggcctttgcctccggcactgccgcatggttcgacagcgcagctctgattttcaccatcaagcgggacggttctgttgaactgatcaagggccgcggcgttgccggcgcggagccctataggacgattcctaatgttttcgactttaatgacggccacattgaactcaccacgaagctgaacggcgacaattatatcgtaacagtcaatgaaggctctttcaccattccggtaagcgaaattgcggagctgtttacaccggcggaagaagggcagaaggagccgctgaatccggagggggcctatgttaccttctcgaaggaagcgggatgcgccgtgaccttcgaggtgaagaacatcgtcggtgagaaggaaatgatcgaattcaccccgactccggccgatcagctgaaaaacccgcccgcggagggggatatccataatctgtggaataccccgggcgtaacgatcggtgaagcggccaagaccggcacaaaactgacctttgctgcaggggcaatagctgccggtacccgcgtgggaaccaaagatacctatgatctcagcaagatgcgtgtggtgatcaacggcatcgagggtgatgccggtgtccgggtggtaatgacctccgatgacaatggttggaccgacagatacagcgtgatggtcagcatcaatccggacaatacgctttcggtggctaaatactatgaacccggcaagggaacgaacgcgatcatcaccagtgttccgctgaccaccagtgtggacgaagtcattgagctgaccttccgtcttgttggagaggaatacgtcctgaccgtcaatggacaggaggttaaagtcacgaaagaaacactggcggatgtttttgctgagggcaggctgcagtacaatgctgcatatctggctttcggcatcgccgctgacggtactggcgcctacaatgtggcg

SEQ ID NO: 2778 - DNA, 507 bp, Unknown
  Description of Unknown: sequence from a bacterial species not precisely identified
gtggacagtgtgcagagcggcacctaccggatcgtccgccaggacaatgtgctgcgggtgtattacacgatgggctttgacccggagagcattttcctgccgatggtgttcaccgaggaggtgtttgagcagcggatcaaggcaaatctgaacggttcacagaaccgacagcttgccaagcactatgcgctgtattcgccggagaacaagggcgatgattttgcggataagctgaaggattatcctgcactcgagcatcaggcgctgtatatttacacgtcgtcctacgatatggtgactgtcaagagcgtggcatcgctgatgcagaaggcgggctacaccgccgaggaatatgaaagcgatactgccgatcttgaggtggaaagcagcgggctgatgccggcgggttttgtgatcccgctggagctggaactgaccgagaccggcctgtctgccagagtgctgatggaccgggtggaaacctccaacgaatccgatcagctggtc

SEQ ID NO: 2779 - DNA, 591 bp, Unknown
  Description of Unknown: sequence from a bacterial species not precisely identified
atgaaaaccaaatccatgcgttttcgcaatcatgcgtacgggtacggatttatgctgccgttcttcgtcctgttttttttgtttaccattatcccggtgtttatcgccgcgggacagagcctgaccaactataacatgatgcagcctgcacggtttgttggcctgaacaacttcaagctgctgctccttgatgacgacatctttctgaccgccatcaagaatacctttgtattcgcctgcatcactggcccgctttgctttctgctgtccttctttttggcttgggtgatcaaccagctgcggtttcgcaccgtatttgcgctgagcttttatgctccctccatcatgagcagcgtagccatctcggtggtgtggctgtactttttttccggcgaccgttacggcttggtgaataacctgctgatcaatttggggttgatttccacgcccatccaatggacacaggatgccaactacatcatgacggtgatcgtgttcgtgcagatttttaccagcatgggcaccaacttcctggtgtttctggccggcctgcagaatgtatcccgcgagctgtatgaggcggggcgcatc

SEQ ID NO: 2780 - DNA, 891 bp, Unknown
  Description of Unknown: sequence from a bacterial species not precisely identified
ttggcactttccatcggactttctgttttgaatagtggggtgaataaccggttctgcaaatcgccgcgctggactccggccgccgccctgctggtcaactgcctttcctgcctggttgccgcctgcgtgctgttcgtgttgtcgcggggcgtcataacggcctcgccgtttaccgtttgtctggggatattgtttggtatcattacggcgctgtcgttgtcatttaatttggcggctttatcctccggccctatgaatcttacggtgatgctggtttcctgcgccatgctgatccctgctttggcggggccgctggtctggcatgaggcttttgtgccggagcaaggggtaggcctgggcttgatgacggtctcctttttgatatgtttttcctcgcgcagcccgggaaaccgctccccgcgatggcatctcttcacgctgggggctttccttggaagcggatgcattggtgtgctgcagaagatacaccagacctccgtctaccatgaggaactggacgggttcctttttgcggcgtttgtaagcggcgcatgcgtattgggcctcgtgcttttgggcaaacgccttcgcgccgccaaacctgctggagatggcaccccgctgcggcttttgctcacaattgccctcgtaaacgggatatgcactgctttgatcaataaactcaatttgtatctgtccggcgtcctgccgggcatcctgtttttccctctggtcaacggaggagtcatactgctttccattctggcgtcccgggttctgtttcatgagaaaatgacgccgaaacaggttctgggggttgttttgggcgtgctttcaatttttctcatcggcaattggtggtcgttccttctgaatattttttcaaaatag

SEQ ID NO: 2781 - DNA, 1314 bp, Unknown
  Description of Unknown: sequence from a bacterial species not precisely identified
gatggcgcggcgctgatcggctacatcggcattgagaatccgcgggagaatctggataacaccacgctgctgcagtcactttcctattttctgcacaatgaaatcagcaaacgttccatgcgggacaggcaggcctttatggaaaggcatgatgccatgaccggcattttgaactggcagagttacagtcagtttctctcccaaatgcatccggaagcgctgtcctctctgggaattcttgcggcggagatcaatcacctgcggctgctcaatcaggagtatggtcaggcctatggaaacaagctgattaagaccctggcggagcgcctgcaggaaaaattcggtgagcaggcggtattccgtctgtccggcggatcctttgctgcgctttgtcaggatataacctatccggcctttttggataaagcggaacggctgcgcagtcagacggaaagggaatatcccggcgcagtggcttttggatggtcatgggcggatgaagatattcagccggatcgtcttatgaataatgcgcaggaacttctgacaattacacaaggcggagagagggagtacgacctgcgggaaagccggcggaaaaccattcgtctgcagcgcctgatgatggcgatgcgcgagaagcgtttccagatttatctgcagcccaaggcggaaatatccactggcagaattgttggtgctgaggcattgattcgttacgtggatgaggtgcacggcgtcgtcccgccgattaagtttattccgcagctggaggcggaaaatactatacgatttattgacttctttgttctcgaagaggtatgtgtcatgctgaagggttggcaggaacaagggatttcgttgttcccgatttctatgaatttctcccgcagcacgttgatggaggacggcgtagtggaaaaaataaaagcggtttcagaccgatacggcgtcgaaagatcccttttggaaattgagattaccgaaagcaaaggggagatggaccgcagtgtactaaaaaccatcagccggcagctcatcggagccggttattgtctctcgctggatgatttcggtgcggaatacagcaatatatctattctctcggctattccgctcaaggaactgaaatttgacaaaagcgtgatcaatgatctgtattccaaccccacgaccaggctgctgattgcgaatctgatccgtgtatgtcaggaaatcggtgttgacagtgttgccgaaggggtggaggagccggaacagttggaactgcttaaatcctttggctgtacttatgcgcagggctacctgttcaat

SEQ ID NO: 2782 - DNA, 969 bp, Unknown
  Description of Unknown: sequence from a bacterial species not precisely identified
cccgcctatgcgttcggcggcacatttgatggacagggacatgtgattaacgggctgtattcccatgaagattaccgcagcgatgatcccgacaaaaccgcacacaataccatccggcacgggttgttcggcgctgtgtatgaggggactatccggaatctcggtgtgcgtgatgcggatattctgatttccgaaaaggatgtcagcacctatggcatgggcattattgtggactggtttaccaattcgacgatgagcggctgctattcgaccggcagcattaccggtggatcgtatatagaaaaatacatcggcggactggtcggctttgccaacggcgatatcgcgatccaggcgagctattctcaagcggtgataaccggcaattacaccaattccggcgattattatgacgacggtatggtgtactgggattccctcggcggcattctcggcgcctcttataccggaacagcgacgattaccgactgctggtatgacgggaaaatcgtcgtcaatgccattcaggctccggtaggcggcattgtcggttatgcagagggggctgtcgtggacaattgtatggtagcgacgacggacatcggcgtggatccgacggaagaaggaaacacctgctggatcggttatgtggtggataccgacgtcaccaactgtgtttggccggatgacgatacctatatcgccagtatttataacgaggaaagcggcaatcctgcgggaaccgccacaaacgattttggagatgctgctgttctggccgggcttcaggcaaatgcgcaggaaggggtaaactgggtctgggggatcgatcatcccactttcgccggggatatttacaacatccccgcggattatgccgccctcgacaaggtgcttgaaacgatcccggacgatctctccctctacaccgacgaatccgccgcggcgcttcaggcgctgattgaacag

SEQ ID NO: 2783 - DNA, 1059 bp, Unknown
  Description of Unknown: sequence from a bacterial species not precisely identified
accggcggcgagcacgatctggaaatcgatacgtacaaatacagccgtctgacaggcaagcaggatcgggacaacggctcttttctggataaggaaatcaccattacggtaaaagaccttaatgggattgctatctggggtcagcgcaataccgaaaatacggtcaacgtaagtttcgaaaactgtcagaacatgaaccgggtttatatcagcgggggaaagggcaaaaacaatatcagcctgaagagctgctcttttgtcgcggaaaacggaagccatgcgaataccagcatctattccaatgctgaggggacgattcgtatcagcgattgcacctttgccggcatctcggtgccgatcaacctgaacaataaatccgccggaacgcagaccgttacggtaaccgggacgacatttaccgattgttccacagcagcgggtactgcggcaaacaatacggccacctatgcggcaccgatccgtgttcttgcacagaaaggggccactaccagcctgacggttgaagaagcggcgtttgtctatacgggtgaaaacactcaggcaggcaacggcgatattcttctgggcgacggccgtgcggactcgttcggcagtgatggtcagccggaggctaccggaacagtcaacctggagagggatcaaacgaaagcgactattcataagcaggttcccggctattacggcgcggacggaaaggttgccgacgcggagaagaacgtgattacaaaagccaccgctaacgaccgggtgattacgaatacggatgaaagccttacggtcgtatgcaaacatgtgaatatgaaggaaacggccggcaaagaggcgacctgcaccgaagacggtgtggaaacctattgggtctgtgaggattgcaaagagatgtttgccgacgcccagggaaaaacgccgattgaaaaaccggtggttattgcggccaagggacacagctttaaggatggcaagtgcaccgtatgctctgcgacggatccggattatacgggaaataacccggcaaccggtgtggaaagcggtctgctt

SEQ ID NO: 2784 - DNA, 879 bp, Unknown
  Description of Unknown: sequence from a bacterial species not precisely identified
atgaaaaaacgatattcttttgccgcagcggtattcgccgctgtactggccctttcggtaaccgcctgcagtacgcagaccgaaggcggaacgggatccggcgatccgtcatcaaaagcatccagcacgccgaacactactgcggcaccggctccctatgaggtgtacaagcaggcaatggaagcgactgaggctcgtgagtccggtaaagacagcatgaaaatggaaatcagttatgatatgtccggcgtggcggttacggtgaaagtgatgcaggatctcacttatacaggcaaaacgatggacgacgaaatcctgatggatatgcagatggaatttatgggccagaacatgaccaacacggtgtattataaagatcaaaacgcttatatgtcggtcatggggcagaaggtgaagagtccgatcgcctcgcaggaagaattaaacgaggcgctcagtctcgaagaaagcggtacagatgacctggatctgacggaagagaattttaagaaagctgcgcttacagacaacggagacggcacgcagacgctgacggctgagctcagtgatgagatggcagccagcttctcgaaggaactgttggaatcgatggaaatcgccagcgattccctgaaaatcgagaacttttctctggtgatgacgattcgcgacaaggcgctggccagcataaagatggatatcaaaataaatgcggcggtggaaatgcccgatatgaacgatcccaccaaaacaacctccacgcagacagaaatggtcatttctgcagaaatgacttacagcaaaccgggagaaacagtgaccattaatccgccggcagaccttgacagctacctctttctcggcggtgaagctgcctga

SEQ ID NO: 2785 - DNA, 1503 bp, Unknown
  Description of Unknown: sequence from a bacterial species not precisely identified
gagtacggaggcggcgaaagcggcggcgcactggccaagtataataacttcatcaatctgatcgatgataaagcggttaaagaccggatcatcgtcgtgggttcaatcggcattaacgccaaaaattccacggacagcgaaacccggtacagttattcgacattttccaatgtcggtgaccgtgtggatgtcgtggcaccgggcgaggatatatacagctcggtggtgtcggggtattcgctcatgagcggcacctcaatggccgcaccgcacgccaccggtgtggcgggtctgctttttgccgcaaatcccgacctgactggtccgcaggtcaagcagctgatgatcgcctcaacatccggccggttttactacgaggatggcagcagcggtttgatcaatgcggagaaagcggtcgtcagcgggctgcagaccgaaaagaaatcggtctcctcggtgatcaacaaccagaccaatagtggtctggatctgtgctttgtggtggataccaccggttcgatgaaggacgatatcgataacgccaaggaaaatatgagcaaaatcctggcccagctctcggaaaagagcgcgggctaccgcgtggcactgatcgattaccgggattttccggatcgttccggcagcgataaggattatgcggcacggatccagctgaaattttcggataacgcggataccatcacccgggcgatcaatggactgaccctcggcgatggcggcgataacgcggagacagtgtattccgcgctcatgaaggcggtggagctggattggaatccggcttcccagaaggttatcattgtgctgggtgatgccccgccgctggatccggaaccgaatacccaatatacccttgatgaggtgatcgccgcgctgtataacgcggatttggcgatcgatatggaaaactccgaccatcgggtgctcggtgatgctgaagacagcgccattacggtgtattcgatcggcaccagcgccagtgattctgcggcggactatttcacccagatcgcggagcagaccggcggcgcgtataccggggtggacgacgcgtcgaaggtttccgatgccattatggactccattgaacaaatcgagatgaagccggtcggcaatgccaccgtgtcctttggtgatgactgcaccggagagatggtcgaggtctatcgggatggtgtgtaccagtttgaggtccgtgccgatgaaaacggcagtgcccggctggaggatatggaactcggtgattacgactggcagattatgcggttgggcaaacgcggcggctttgaaatcgaaagtgccaagcgctgggccaatgccacccatgatgacagctggtattcctttgcattggcgatctggtaccggcatcgggttgagctcatcggcggcgctgtgctggcagttgtggtgctcattgtactgattgttgtcgtgaaaaagataaagaaatattgtcggaagagggctgccgttaaggcg

SEQ ID NO: 2786 - DNA, 615 bp, Unknown
  Description of Unknown: sequence from a bacterial species not precisely identified
gattctttgcttctgattaccatagatgcggcggagaataaaacgacggcggagctgaaaaccctgcaggaaagctctctggcggtcattggcgccgtacagctggacggctatgtgcagaaaatcgtccgcttttcgatgggaaagctgaccgatacggtcagcggcatttatatcgattgcctcaaggataccggcgcgctgatcaccgaactgatttactgggacggtgagcggctcaatgcaccgttttataatgccaaggtgaatataaccactcagacggcacgcaggcagatgataccgtcaatggatattgattccgacggcgcggtagagtggccgacctgcgaactgctgcccggctacacagaggaaacggagccggatgcgatgtggatgacctattggaattcctttatttatgacacccatcagacgcaggtggatctggcaggcatcgtgaacctgatcgatggctattgcctgcggatcgaggaaaactgggacggccgggtcacggcggcgtacgatgccgatgagcatgaactgcagctgcaggatgcgcaggaaaaggaaccgtttttgattgtgcgtgccgctgccgcggcaaat

SEQ ID NO: 2787 - DNA, 1095 bp, Unknown
  Description of Unknown: sequence from a bacterial species not precisely identified
atggctgacgaaatcaaactggaaacgatgccgacccctgcgcttacgctggatccgtttgatgagaagaggatcacggcggcagaaccaaaagatgtggaaccggtagtgctggatcagtctatactgacgccggaggaacaggcgatggtgaacaatttcgcggccaccatcgacgttaccgattcgcaggtggtgctgcagtacggtgccgcagcgcagaacaagatttcctctttttcggagaacgcgctgaattcggtgcgcaccaaggatatgggcgaaatcggcgagatgctgaccggcctggttaccgagctgcgcggctttgatgcgcaggaaagcaagggctttttcggtttgtttaaaaaatccgccaccaagctcaaggcgcagtatgacgatgcggcgaaaaacgtggagaagatctgcacggcgctggaaagccatcaggtgcagttgatgaaggatatcgcgctgctcgacgaaatgtataagctgaatctgacctattttaaagaactgtcgatgtatatcctcgcaggcaaacaaaagcttgaggaggtgcgcaccaccgtgctgcctccgatgcaggaaagggccaaggcctcagggctgccggaagacgcgcaggcggcaaaggatatggacgacatgtgcaaccgttttgagaagaagctgcacgatctggagcttacccgcatcatttcgattcagatggcgccgcagatccgcctcgtgcagagcaacgacaccatgatgaccgaaaaaattcagtccacgctggtcaacacgattccgctgtggaagagccagatggtgctggcgctgggactggagcattctcggcaggcgatggaggcgcagcggcaggtttcggatatgaccaatgagctgctccggaaaaatgctgaggcgctgaaaacttcgaccattgaaacggctaaggagtccgaacgcggcattgtcgatatggagacgctcaagcataccaacgagtcgctgatttccacactggacgaggtgcttcggattcaggatgagggccgtcagcgccgccgtgaagcggaaaccgagatcggccggctggaaggc

SEQ ID NO: 2788 - DNA, 510 bp, Unknown
  Description of Unknown: sequence from a bacterial species not precisely identified
gtgctgacgccgcataaagaggtggctgaaaaggcaaagcttctgatcaatcacggcatgaaggtccgctatcaccacgatatcatcggctacaactatcgcatgacgaatatggcggcgtcgatcgggctgtgccagctggccaagctggatcgtttcaacgagctgcgcaaccgcaatgcggattattatgctgcgcatattcatcacagcgatattgacacaccggtgtgtgctcaggatcgttatcactgctaccatcagtataccctgcgcatcaaaaacggccgcagggatgccttcacccagtatcttgcggacaacggaatcggtttcggcgtattttatccgctgtctattccggaacagctgtgctataaggagatgtccttcccgacacagtatccggtgaccgatgtgatcaaaaatgaagtggtttcgatcccggtgcatccgcagctgaccacggaagaagtggagacggtggcccgggtcatcaacgcattttga

SEQ ID NO: 2789 - DNA, 1083 bp, Unknown
  Description of Unknown: sequence from a bacterial species not precisely identified
atgcgacaccgcaattcttttgtttttattgacaagtttcacaaaactcaagcagtcttaataggcatacctttttatatcagaatggacaggatggttgatttgaaaaaaattatcgcaatactggcggtcatcaccctttgtctgacaggctacacgctgcgctatgctgaggacacaatcgtgatttgttcatcgagtgaacagttccgcaacgattacgtacaggaggatctgcgcaggcagttccctcagtacaacatcgtggtcatgtacatgcctaccggaaaagcggctgccaaggtggccgtggaaaagaagaaaaccgacatcgatatccttatgggactggaaaccggctacttgtctaaaatccaggatgagctgaccgatgtacgcggccgcagcagactggattatctgcccggtctgtctccagaggagcagggcggcaaatgggtaatctgggagcgctttgctggagctatcgtcgtcaaccgcgatgttttgggcaaatacggcctccccgcaccgcagacctatgaggaactgcttgacccgcggtaccgcaacctgattgccatgcccgatcccaaatccagcggtaccggttatttcttctatcagaactgggtgaacctctggggtgaagaaaaaacccttgagtacgtcgataggctgcatgaaaaccttaagcaatttaccgaatccggttccgggccgatcaagatgatgattcagggcgaaaccgcaatcgggcttggcatgaccttccaggcggtcagcgaaatcaacaatagcgtgccgctggaaatcatctacccgcccgaaggatctccctattccctcaccggtaacgccattgtggccggcaaggagaaaaaaagcggcgtaaatgaggttttcgattatctcattcaccaaagcatggtatatgacaaggagaatttttctcctgaggctgttctgaccgaacaaaacaacaacgtacctaactatcctcagaatatccaatatgcagatatgtccggcatcgacgacgccgatgagaaagagaggctgctcaacttatggaagtactga

SEQ ID NO: 2790 - DNA, 672 bp, Unknown
  Description of Unknown: sequence from a bacterial species not precisely identified
gtggtcaaagcggtttttgtcgattacaccggtaccgtcgtaaaggaaggcggtccggaaatggaagaagtggttgcgcgcatctgccgcggcagcgatctgcatgatccgcagcaggctgtggctctgtggtggtcgctggtcaaacagtacgaagaaagctgctgcggggaaacgtatatgaccgaggatgccattgtggatcgtattcttggcgagctggaaaagcgcatcggcctgcgggagaatgcgcaggagctgcacgaactcatccgcggcttttgggtgaatgcgccgttatttgcagatgcaggtgcgttttttgcccactgtccgctgccgatctacctgctgagcaataacggggcggagtacgtcgggcagtctatgcggaataaagatctgcatccgtcgggcatcgtgtgtgcggacatggtgcgcgcgtataagccgcaccgggcgatattcgataaagcgctggagctcagcggctgtcggccggaagaggctgtgcatatcggcgattcgtatacgtcggatgtgcagggcgcgcggacggccggaatacggccgatcctggtgcagcgaaagacgggcaagacctacgcggatatcgccgttgtcagggaccttaccgaagcactgccgcttttggcgcagcagcaagaataa

SEQ ID NO: 2791 - DNA, 777 bp, Unknown
  Description of Unknown: sequence from a bacterial species not precisely identified
aagaaaaaagaggtgcctgccgtacctttgcacaaagccgaagagccgaatgccgaacagcagaaggcggtgcaaagtacagctgctgttacggctgttatcgccggcccgggcacgggcaaaaccaaaacgctggtgtcgcgtattcagtacatggtaaaggaaaaaggcgtaaagccggccgatatcacggcggtaacctttaccaataaagcagcggcagagatgcgtgagcgtctggaaaaggttttgggacgcacagcggcaaaagcgatgcatataggcaccttccattcgctttgtctgcatctgctggaaaacattacgctcattgatgaggaagaagcgcagattatcgcagctgaagttctgcaggaatgccactgcaagcagtctcccaagcggtttctccaggcggtttcccgacagaaaaacggcacaaccgaaacggatcttgatccgaacgctttcgccctctatacgcagcgcctgcaaacgatcaacgcttgtgatttcgacgacctgctgctgcgggttctggaacggtgtgaagcgggaactgtttatccgcaattcacacatctgctggtcgatgaattccaggatattgatgaactgcagtatcgtctgatcatggcttggagtcgtcagggaaaaacgctgtttgtgattggcgacccggaccagtctatttatggtttccgcggcgcggatgcccattgcttcgatcgtctggccgggacatatgccgaactctctaccattcgtctgctgcgc

SEQ ID NO: 2792 - DNA, 840 bp, Unknown
  Description of Unknown: sequence from a bacterial species not precisely identified
gatgaagccatccgcgaggttgtcgccgaacagctggaatttgcggtaaccgatatccggcaggcacagcggctctggttcgggcaggatcagtcttcctccctttccggcgagacgtatatctggcagaccgtggcgatcaaaaccgcaatgggtaccacctaccgccggattcccatgacgatgggcgaccttgctgttatcacagaacatctcgaggcaaatgcggactaccgccggatctatatggagctgcctggtctggatgaagataacctgcaggtatcggtttccggcctgaccgaggaaaaggcccgtgagctgtacgccattgcccgcgaagaaatcgccgatctggattttgcgatgtggtacgcctgcctgaccggcagaaaccccgttggggacatagagatcggcgaccaggcacagaccgcctttgcagcctccctgccggcatccatctcggtgagcggttaccgtggggcgcagagttattctttggatttcccgctgtatactttcctgccggagacttgtgaacagtatctcgcccggtataacgaaggacaggccgcacaggatttcttccgctggctttcggaagcgggcggtgaggactgtatggtctccatcacctggtacgacaccgcattttccggagagaactacaacaatttccgcggaaaggcctggcctgcctttatggaggcacacggacaggcgctgcgggaaagcctggaatccacagcggcgccccgtatggacggcaccttgctgcgtatctatgtcgaggaagctgacaaaaacggctattatgtctccacggatgtttactgc

SEQ ID NO: 2793 - DNA, 507 bp, Unknown
  Description of Unknown: sequence from a bacterial species not precisely identified
atgctggaaagaggggagctgccgctgcgggtcacccataacgacaccaagctgaacaatgtgctgctggatgaacgcaccggtgagccagtatgcgtaatcgatctggatacggttatgccggggctgtcgctgtatgatttcggggacagcatccgctttggcgcaagcacggcggcagaggatgagacggatctgcataaagtgtcgtgcagtctcgaactgttcgaggcttatgtgcggggctatctgagcgaatgcggcgacagtctgacggcaaaggagatcgaaatgctgccttttgctgccaagctgattaccttggaatgcggcatgcggtttttgaccgattatctgcagggcgatgtttatttcaaaaccagccgtccaggccagaatctggatcgctgccgtacgcagttccggcttgtggcggatatggagagcaaacaggcccgcatggcggagatcgtcgccgtgtatgcgcctgcaaaatgctccgaataa

SEQ ID NO: 2794 - DNA, 735 bp, Unknown
  Description of Unknown: sequence from a bacterial species not precisely identified
ggtcgtgacgacgtgctgtccgatagcctggtgcgcggcgtactgggtttcttccgtacgctcgttgagccacaggacagcgcatcgctccaaatatgtttgaagatgctgtggaattgcgggaaagacacacttgctgcgattcgcaaggaaaagatgacgcccgctgcgctggcagaggggagtgctttggaaaaagaggaattcgtacgctgctggctgggtatgtatacacaatataaggcgagactaaccgaggaaccgcatcttcttattgaggatcttctgcacgatctggaaatcgtcattacgcccgcacttgatcgcttggcgcatatggccgtgctgcatcggcatctgcaatcttttttgcaagagcttacgcttggtgcggaaggcgatgttcagcgcagcggaggaaaacagtatacgcctgacgcggtaacgctgatgactctgcacggttcaaagggactggagtttccggtggtttttctttgcggtgttaaacgaggcagcattccgttggaaacccctgggcgtatgaccgatccggaagaagagcgccggcttttttatgtgggaatgactcgcgctaaagaagaactcattctgctgacacagaaggacgaatccgtttttctgcacgatattccagtgtcattgtgccaatttggacaaacagcggattatcgtcctttgccgaaagcaaaacagctcagtttttttgactga

SEQ ID NO: 2795 - DNA, 573 bp, Unknown
  Description of Unknown: sequence from a bacterial species not precisely identified
atgccgagtttaaaaagcaaactgctgtatggggcactgaaaagtgtcaagccgctgctgaccggggtggatatccccaagcagcgcaaggggatggacctgctgcggtatgtatacgcgctgcccaaaagtgtggaactgcgcaaagctgagggcggtatacggggagaatgggcaattccggccgacgccgtaccggacaaggtgatcctgtattcgcacggcggtgcctatatttcgggatcgccgtccacacacgagccgatcatctgccggttggccgagcagagccatataccggtttttgcctatccttaccgactggcaccggaaaacccgtttccggcagctctggaggatgccagggcggcggtgacctatttacaggcgcagggctatgcactgccggatatggtattctgcggggattcggctggcggaggactgacgctttcactgacgatggcactgcgcgatgagcgcagcgaactgcccgcagcgctggtagtgatttctccgtggaccgatctggcgatggcacgccgtagtcaccgcacgaatgagccgatcgat

SEQ ID NO: 2796 - DNA, 516 bp, Unknown
  Description of Unknown: sequence from a bacterial species not precisely identified
agttcacactggaatccggcctcaaacgcacgcttgactggtatcaggagaaaaacagacatgacggataagccgcttgaacaggaattcctggcctttctggaaaaacggcgtcaggaaatgaaggaaaaatatgatcgcgtgctgccgacgggagaactgctgtttaaccggtatgacaaggcggaatatcttggcgccggagacggtacttcggtttacgatacgagcgtgatcatgggggacgtccggttaggcagacatgtatgggtagggccatatacgcttttggaaggcgtacatgcgccggtgacaatcggcgactttgtgagcgtgaattccggtgtacagatctactcacacgattcgaccaaatactatgtttccggcggcagggttccttttaaggaaggtccggtgacggtgggcgattatacggtcatcggcagcatgtcgatgatttcctgtggggtgacgatcggctcgcactgcgttatcggtgcgaacagcctggtt

SEQ ID NO: 2797 - DNA, 1092 bp, Unknown
  Description of Unknown: sequence from a bacterial species not precisely identified
gccgctgttctcgcgcagccgtcactggtgtgggaaatcgaaatcgaaaaaaccgccgactgcacattgcctccgatcgtgcgacagcccggcgaattacttggtttggccgatatggcgcccggtcaggcaagcgcgttcagcctgccgtgtctgcaccatgtgctgttagaacgtgacggctatttactggatcagccggtcaatgtcataccggcactttcctccgcgtccgctacgctgcgtgatcgggagctgctgatctgcggtacaatcgacccacgcgaggacgtccgggtgacctttgcgattgccggcgagttattttcccgcagtctctctgccgatgccgacggctgttttgcctgccgtctgaagctggcgtcccggcttttgctgcccgcctattctgtccattacctgctgcaaacaggcagccggcaggaaagcggtgttattcgcgccgtcaatcaaaccaatatcgatttttcaggatatccgctggatctgcaagcgtttttcaatgccgataccgtcaatggggacagcccgtggcgtctgtggtatcctgttgaactgcgtttttccgacgatgcctgtgccggcacccattgcgcctatcacttagtaaaaaatgaacaggatgcctgccgcgtctgccggctggaaaaaggaaaaagtaaagaaggcaagcgggaaatcgcttcaacaggctatcccgcagccgcgcagctgcccgtcaacaagtccgtcggcgctgtttccctgctgtatgccgcagacgtggatgtcagattggtacaggaaaccgttggcgccgtcattctggaatataccgacggagaaacggtatctgttccgctaagctgcggcagcaacgtcggatcgctgttccggaatttcgcgcaggacacagttcatgtgccagcactcacccatacaaaccgcgattcggtaaatcactacgccatcccctgcgatgaggacaaaacattgcgctgtgtccgcattgagatcactaaggaggatgtacggtttgcgctgctggccactaacctctatggcactctgcctgaaatttggagcgaataa

SEQ ID NO: 2798 - DNA, 612 bp, Unknown
  Description of Unknown: sequence from a bacterial species not precisely identified
atctatctcgccgatacggacaataagcgggtggtggtgtttgaccgggaaggaaattaccgccgggaattcaccaagccgtccggcagcgtgcagtataacgcaatcgactatctgcccattcgggtggtggtggatcataacaattttgtttatgtggtgtcccgcaatacctatcaggggctgatcctgtacaacccggacggcggttttgagggttattttgccgccaacgaaaccgaggtcacctttgaactgctgatggaccggttctggaagaacttccttaccgatgagcagcgggcgaagaccgccaactatgtgtccatcgagtattcgagcgtggatatcgataaaaaagggtttatgtacaccaccacgctgctgaccaagaccgatacccggcaactgagcaaaatcaacccgtccggcgatgacgtcatgccgactagcccggggctgcacccggattttgcctataagtttggggatctgggcagcgtacaggtggaaggaaccatcgtcaaaacgaaattcaccgatgtgtgctatgacgaggcgggctttatcaacgccctcgattaccagcgcgggcggatttttcagtacagc

SEQ ID NO: 2799 - DNA, 510 bp, Unknown
  Description of Unknown: sequence from a bacterial species not precisely identified
gggttcctgatgccggagtataatgagctgggctttaactaccgtatgaccgatattcagggtgcggttggcctggcgcagatcgagaagtttgattatattctggaaaaacggcgcgagaaagcggcacggtacgatgaaatgctttcgcagcgctgttctttcctgaaaacgccgcatgtgccggccggatattatcacacatatcagtcgtatgtgacgatggtggattatgcggcgcttggtttgcccggcgttccggagggcaacgctttccgcaaccggctgatgggatatctggaagagcatggggtgagcacccggcagggcacgcatgctgtgcatatgctgggctattatcgggataaatacggatatcgcccggagtcgctgcctggagcttatgcctgcgatctgctgtccctgacgctgccgctgtatgtggagttgtctgcggacgaccaggaatatgttgtggagcagctggaaaagggcatgcaggcggtccgg

SEQ ID NO: 2800 - DNA, 1224 bp, Unknown
  Description of Unknown: sequence from a bacterial species not precisely identified
tttttcaatgcaagccgctaccagagtctgctggtgaaaaccgaggggaactttgccgaggatatcgcggagctgaatatgtcgcagattccggtggtggatcgtgacacggcgattcagctgggcgcgcgcaagcttggtgagatgtcggatctggtgagccagttcgagatttccgaggagtactatacccagatcaattacggcgagaaaccggtgcgggtgacgccgctggaatacggggatatcatcaaatggttcaacaaccaaagtgaaggtatcccggcgtatctgcgcctggatatggtgacgcaggaaaccgagctgatccggctggacgaagggatgaaatacgcgccctgtgagtatttcatgcgggatctcaagcgctatctgcggttccattatcccaccaaaatttttgacgaatcctattcttttgagatcgatgaaaacggcacgccgtactggatcgtttcctgcataaactaccgcatcggtgtgtggagcggtgccgacgtagagggagcggtgctggtcaatgccgtcaccggcgagcaccagtattacccggtggacaaagtgccgaactgggtggaccgtgtgtaccacgcggatttgattatcgagcagctcaatctgaacgggaaataccagaacggcttctggaatgcgtattttggtcagcgcggcgtgctgatgaccaccgacggctataactatattgcggtcaacgacgacgtgtatttgtacaccggcatgacttcggtcgccgcggaccagtcgaatgttgggtttgtgctggtaaatatgcggaccaaggagactaaattttacacggtgcccggcgccaccgagaaatccgcacagcgttcggcacagggccaggtgcaggatcaggggtataccgccaccttcccgctgctgctgaatataaatgaccggccgacctatttcatgtcgctcaaggacggcgcacagatgatcaaaatgtacgcctttgtcgacgtggaaaagtacaacatcgtcggcatcggggcaaccgtggccgaagccagacagaactacgccaatgccatcggctctgaggacggggtggaaacgccggccggccagtcggtgaccggcgtgatcggtgagatatattctgcggtgctcgacggcaacacgcagttttatttccggctggaaaacgacgagtcgatttatgtggcgccgattcgt

SEQ ID NO: 2801 - DNA, 768 bp, Parabacteroides merdae
atgaaagtcatcttcttaggttctggcaacctggcgacacggctgtctctcgaaatgcatcgcaaagggatgacgattgggcaagtgtatagctatacaccggaaaatgcacggcagttggccggtcggttgggttgtctttggacaactgatcttgaagctatagagacggatgccgacctgtatgtcttttcattaaaagacacagttttggcgaatgtgattacccgtatacgaccgaacgacggtttatgggtacatacggcaggcagtatgccgatggatattttcagcggccatacggccaactacggagtcttgtatccgatgcagacatttagtaaaatgcgtgaggtagatttcagcgtgattcctttttttattgaagctaatacgtctgaaagtgccagtaaattgcaacaattggcggagaaactttcgggaaacgtccgttttctgtcatccgacaaacgtaaaaatttgcatctggcggctgtctttgcttgtaattttaccaaccatatttatgcgttggctgttaaattgttggagcaacaggatataccggccgatgtcctgctgccacttatcgacgagacggtagccaaaatacatacgatgccgccgagggtggcacagactggtccggctatccggtacgatgaaaatgtgattaataaacatttggctatgttgggggattccgatatgcggtcgatttaccggctgatcagccaaagcatacataaggaggcacgacatgagtag

SEQ ID NO: 2802 - DNA, 1029 bp, Parabacteroides merdae
atgtataagaaaatttatttatcagttattttaggggttttgtttttcatctcgtgcaaagacaaaaaacaatattatgaagaaagtggtaccgtgtttcataccctatacacgatcaaatatgaggcgccctatgctttaacggataaaatcgatgctgagttgcaaaagttcaacctgtccttaaaccccttcaacccaaattcgatcatcgcgaaagtgaataataacgaagcggtagaagtggacgaatggtttacggaggtatttaacaagtcgatggaagtctctcgcaattcagatggtgttttcgatatcacctgtgcccccctggtcaatctttggggattcggtttcaataaaaaggatagtgtgacacctaccatgatcgacagcctcaaaacttttgtaggttaccagaaagtgcacctggaaggtaagaaaatcgtgaaagacgatccccgtttgctactgaattgctccgccatagccaaagggtattcctgcgacgtgatcgctcgcctgcttgaaaaagaaggggtggaaaactatatggttttgattggtggcgaagtggtagtaaagggtgtcaatcaaaatggcgtatgctggcgcaccggaatcaaccttccggaagatgatccggacggtatcaaaaataattatgacgaaatcgtccaactatgtaaaaaaggtgcgattgccacttccggcaattaccgcaacttttatatcaaagacggtaagaaatatgcccatacgatcaatccccgtaccggttatccagccgaacagagcgtgttgagcgccacaatcgttgcaaacgactgtatgacagccgatgcctacgccactgcatttatggcaatgggactggaaaaagcccggcaaatggcagataccttaccagagatcgaatattatgtgatatatgccgacgagagcgggaagcatcagattgaattctcaaaagggatgctccagtatctgcctaaacggaaaacaatgataagctcagataattcctga

SEQ ID NO: 2803 - DNA, 240 bp, Parabacteroides merdae
atgggaaagaaaatcatcggcgtaatcgcttttgcagcgatcgccgcagcagcaggctggaattacaaccagaacaatcagaaagtggaactgtcggatttggcgttggaaaatgttgaggcactggcacgaggcgagggtattgatcaaaacggatacaaatacgttgcagaaccaagaccttgttgcaagaaatattcacacgaatatcaatgtagtgatgtttggccagattgctaa

SEQ ID NO: 2804 - DNA, 654 bp, Parabacteroides merdae
atgcaaatctttttctctctttttgttttcggggaggtttggagaagttcagaaaaagaagttactttgtcatctgttagcataaacaataagataatgacatatattgaaactgaaatttccggtgtgtggatcattgaaccgaaagtttttaaagatgcgcgtggttactttatggaggcttggaagaaagcggagtttgaggaacatatcggcaaagtggaatttgtgcaggataatgagtcttgttcgtcaaaaggtgtgttacgaggattgcattaccaactggctccttactcacagtccaagttggtacgtgtgataaaaggatgtgttttggatgtagctgtcgatttgcgcaaaggttctccgacgttcggaagatatgtagctgtcgagttgtctgatgagaataaacgtcagttttttattccgcaaggattcgcccacggtttccatgtcatgagcgaggaagctgtttttacttataaggtcgataatccttatatgcctgaccatgaacgtggattacgttttgatgatcctgaggttggtgtggattggaaaatcgcggatccgtctgtcctcaacttgtcagataaagacaggaatgctcccttgttacgagatgccgaattgaattttaaattataa

SEQ ID NO: 2805 - DNA, 654 bp, Parabacteroides merdae
atgatcatcagaattggaaaagcaagcgataatgattttgtagtaaacgaccctcatgtaagccggtatcatgcaaagctggtccgtgaagagggaggatattggctacttgaagatttagggtcgacaaacggaacatttgttaatggtgctcagattgttaaaaaacatgttactcccagcgatacgatcaagctgggagataattatgtgttaaacatttccgaggccttgaagtccaacaatgattatagcgaggagtttgcagtgttgaagcagatatacgatgattacattcaagcaaaggttaagatacagtcttctaaccaatttaaaactaggttattccaatcacttccgtttgctcttcctggtgtagtgggggttgtgatcggttttctagggaaaggaagtccggaattgttcggactgagcttgtttatcacgatctgcgctccgacggtcggtatctatctgggtgcgaaacaatcagccaaaatcccacagttgttgcaagatttgaccaatcaattcaaaatcgactatgtttgccccaagtgtggaacgtttttgggtgaaataccctgggaatcattgcgcaataaaaaacaatgcccgatgccttcctgtaaagctaaatgggtgagcgaatag

SEQ ID NO: 2806 - DNA, 1428 bp, Parabacteroides merdae
atgaatatcaacaagaaaaattgtataatcctggcgctggccaccttacccatgctaaattcctgtagtgacagttggctggagccaaaacctctgtctttctactcacccgaaaacacatacgtggatgcagaaggactttatgccgcattgacagcctgcgaacgtaatatgcgccatgaatttttcggagacggcgctccgatcctaacggaaatgtatctgaccgacatcgccatacatggcaaaacagacgaaagcggttccctggtcgatttggataacgaaatgttaccctcccggacgaagaacgacatgaaaggtaaaaacaaatggtattgggaagaaggattcaaaggcatcaaatatgcaaatatcgccatcagccgtttggatgctgccaaatacaaagacgaagcagaacgaaaggccgtattgggcgccgcttatttccaacgtgcctatcgttattacaaactgacacaccagttcggcgacgtcccttatctggatcgggaaatcaccgaaccgaaattggatttttatacgtacgaccgttggagtattttggaacaatgcaaaaaagacatggagtttgcctaccaatgggtaccggaagtacaaccgcgcggacgtgccaacaaggacgcgtgcggtgtcttgcttatgaaattgtgcatggccaccggcgatctcgaccgcgctattacggtcggcaaagaaatcgtcggacgtcatccgttgatgaccgaacgcttcacagggaatcaaacaaaacccaacaccaacctgatgcatgatttgcacagtgtagaagccaaaatagacatgaacaacacggaaggtatcatgtatgtggtcgcccatccgacaacaacccctttggataaagacaaccgtatttataccatgcgtaatgctgtgccttactgggcaaaaggtggcgctattaaaaccccggacgggaaaagcggcactgctattgcacccgacgaggcggacaagaatacggaaatagataatgacacccaatacggccgcggtatcgggacgttacgtccaaccaattattaccaatacgagatttggactgaaaaagaaaagaatgacttacgcggaccattcaatcatgacagttggaagcggatggaagatttacgctataacgatcccggcttgaagaaatcaaacaatccttattacggacaaaacttgattcgcccggtagacctttctgtcgccgactctatccgttgctggtacatgtggccacattacaaagtattcgtccctgatccgacaaagactcaggatttccaaggaggagaaacaccgtggtatatttatcgttctgcagaagtttacttgatgttagcagaatgttattattggaaaggtgatatggcaaatgaggctgcaatgctgaat

SEQ ID NO: 2807 - DNA, 240 bp, Parabacteroides merdae
attctgtccgtttgctatccataccgaaaacaaggatatcagcaaaaaaacaatcttcttccccatcacgatttcttatccttttatttttactttatcaataaaaaactcctcatgattcgagatggctttttgagtcatattcgtcgccttaatgaggaagatagcaggctatctgacgaaggagtgggacggatatggccaaaagatactcaaagcataagcgaaaacaacagctaa

SEQ ID NO: 2808 - DNA, 1098 bp, Parabacteroides merdae
atgaaaaataaaagactgtctatctacgaagaatgcttgcaaaaaggcatctcccgccgggattttctgaaattctgtaccactgttgccgctctgatcggacttgaatccaatggtgtggcacaagtagtaaaagcactggaaacaaagccgagacttccggttatctggcttcatctgcaggaatgcacctgctgtagcgaatcgttcatccgatcttatcatcccacggtagggaacctgctgttcgataatatctcgcttgactatacggaaacgttgatggcagcctccggcttccaagccgaagcttgcaaggaggaaaccatgaagaaatattggggtgaatacatcctgatgatcgaggggtccattccgactaaagacgaggcctattgctgtgtcggtgggaaaagtgccatgcagattgtcgaagaatgcgccgaaggtgccaaagcgatcattgcgtggggcaattgcgcctctgccggctgcatacaggctgccaatccaaaccccactggggcaaaagccatacacaagttgatcaaaggcaaacctctgatgaacgtgcaaggctgccctcccatcgccgatgtcatgacgggcgtcattgtctatatgctgacctacgaccgtataccgcagcttgatgctctcggacgcccgaagatgttctatagccgccgcgtacacgatacctgttaccgccgtgccaatttcgatgcaggtctgtttgtcgagagtttcgacgacgaaaatgccaaacggggctactgcttgtataaggtcggctgcaaaggacctaacacctacaatgcttgcggtatcattaaatggaacgaaagtactagttatccgatccaaagcggacatccatgcttgggctgtagtgaagcgggattctgggatatgagtcccttctacaagcgactgcccgatgtacatggtttcggtattgaagcgactgcggaccaaatcggtttggctgttggtgccgccactgttgccggtatcgccgtgcatgccgtagccaccaacatacgcaagaaaaagttgatcgacaatgatgaacctgaaagtaagtcgaccatttaa

SEQ ID NO: 2809 - DNA, 1308 bp, Parabacteroides merdae
atgaaaacaatctgtctttattttgaaatacatcaaattatacatttgaaacgctatcgttgcttcgatatcggtacggatcattactattatgatgattatgaaaatgaacgcagtatcacggagattgcagagcgttcttatattccggcattgacagctttgcttgaaatggcaaagagcaacggaggagcttttaaagtcgctttttctatttcgggtgtggctttggaacagttggagatctattctcctgccgtgattgacttgttgcatcaattgaatgatacgggctgttgtgaatttttatgcgaaccttattctcatgggctttcttctttggctaatgaagaatgtttccgggaagaagtttccagaatgagtgcgaagatcaaacaagtttttggacaaactcccaaggttttccgtaattccagcttgatttattcgaatgagatcggatcggttgtcgcaagtatgggatttaaagggattttgaccgaaggagccaaacatgtgctgggatggaagagcccgcattatgtgtatcattgtgcctataatcctaatttgaagattttgcttcgtgatttcaaattgtcagacgatattagtctgcgtttttcaaattcggattggagcgaatatccgttattcgcagataaatatatcggttggattgcaggtttgccggaagaagaacaggttatcaatatttttatggagctttctgctttgggcatagcacagccgttatcttcaaatattctgcaattcatcaaggctttgccggcttgtgcgaaagaaaaaggtatttcattctcgaccccatttgaaatcgtgacaaagttcaagtctgttgatcaggttgatgttccttatccgatgtcatgggctgatgaagaaagagatacaagttgttggttgggtaacgtgatgcagcgtgaggcgtttaataagttgtatagtgtggctggtcgtgttcatttatgtgatgatcgtcgtatcaagcaggattgggactatttgcaggcaagcaataatttccgttttatgacgaccaagaaaaccgggatttggctcaatcgtggtatttatgattctccgtatgatgcatttaccaattatatgaatatattaggtgattttatcagtcgtgtagatgccttatatcctgtcgagatagagaacgaagaattgaattcgcttcttacaacgattaagaaccaaggtgaggagattgaaaagttacagaaagaacttgacaagtataagaaaaaagcagcgaaaaaagcggctgctgagtag

SEQ ID NO: 2810 - DNA, 591 bp, Parabacteroides merdae
atgaaaagcatactcccaaacttgagtcaatataaaatcgtattaggctccaattctccccggaggcgcgaattgctggcgggattggatatcgaatttgaagtacagacgattccgggtatagacgaatcctttcccaaaacgttgcgcccagatgaggttccggtctatatcgctaggaaaaaggcggaagcctacattccatccatgtcggctgacgagttgttgatcactgccgatacgatcgtatggactttcggtgaaattttaggaaaaccgaaagaccgcgaagacgctatctccatgttgcggaaactgtccggacgtgtacatgaggtgattaccggtgtttgtattactacaaaagagaaaacggtttctttcttcgcttcatcggccgtttgttttgccagcctgaataatgatgagattgcctattatgtcgataaataccgtccgtttgataaagccggcagctatggtatacaggaatggatcggttatgtagcggtcgaagccatcaacggtagtttttataacgtgatggggttgccggtcaggctgctttaccaagagttgaagaagttttga

SEQ ID NO: 2811 - DNA, 927 bp, Parabacteroides merdae
atgatcaacagaattttaatccgcattaaagttttacagatagtgtattcttactatcaaaacggaaacaacgacctcaaagtagcggaaaacgaattgcttttcagtcttaaaaagtcttatgacttatatcattatttccttcttctaattgtcgacgtcacaaatttacaaagacgcatcttggatgcccgtaagaacaagtatatgccgacagaagccgagttgaatccaaatacccgactggtagacaatcgttttactgcacaaatagccgaaaacgaagcgcttcggaagtacgtggccgagcaggggctttcatgggataacgatggagatttcatcaaaatggtactcgacatgatcttatcgtccgaacagtacggggaatatctgaacaacgaaaacgattcatacgagacagacaaggaattttggcgcatcgtattcaaaaaactgatctgtggcaacgaagcgatcgacgactacctacaagacaaaagcatttactggaatgacgacatctccatcgtcgaaacatttacgctaaaaacgatcaaacaattcgagaaagcagccggaagcaaacaaaaattgttgccaatgtttaaagatctcgaagaccagtctttcgctatcaaattattccgccaatcattaatgaaaggaagcgaattccgtgaacgtatcaacaaacatatgaaaaactgggagaccgaacgcatagccaatatggaccttatcatcatgcaggttgcgctggctgaaatcatgacgttcccgacaattcccattaacgtaacactgaacgaatatattgatacggccaaatactacagtaccccgaaaagcggaacgtttatcaacggtattttagattctgtagtcaacgagttaaaaaaagaaaagttattgctcaaagattaa

SEQ ID NO: 2812 - DNA, 1008 bp, Parabacteroides merdae
atgagatataatctttgtgtattggttttgttgtcatttgtcttgtctggttgcgagaaggaaataaatctggaacatatgcgtccaaaccctaaattggtattgaactgtctggctgtgcaaggcgatacactttctgtggaactttcgcgaacttggttttatgcagataacaaagttcaggatatttttgtctccgatgcggatgtgaagctttatgtaaatgatgtatttcgggaatcgttggccgaaacgattgtgaagtatgagaatccggactttgatgccgtactttacaaatcttctttttatatgcctgctgctggcgatcggatacgcttgactgcttcacgcaagggctttaaaaacatagaagctgtgacggaagtcccgcgtccttgtgctgtttccgattttgagtttgaacaggagagtgtaagagacacttctgaatggtgggatgattactatatccatttatcccagaaaaataccttatgttttactcttcacgacgaaccaggtgaagaaaactattatctgatctattttcgtcggggagatgcgtggggtgaaaaagacagccttcgttattcttggttttcttttaggcctgattatggaagcgaaccggtgtttgccgttcagaattcagccttagatcaaattttcggatatgacggtgtgggtggttataatgggcttgctttttcagacgagttgtttgatgggaaaagttatcgatttaagattccttgggaaataagcttaagctatacattgagtactgattataacccgtacaaatatcgttgttatctgtattccatttcccgttcctactacaactatatgaaaactatgaatgatttgtatgagagtggttttgtaggcgacttggcggaaataggctttgccgaaccggtccgcatctactcgaatgtggaaggagggaccggcattttaggaggcggctgtttggggttcagagagtttacaagtgactga

SEQ ID NO: 2813 - DNA, 561 bp, Parabacteroides merdae
atggaaagtttcgcaacattaataaagaacagaagaagtatccgtaaatttacaggccagttactgaatccggatcaggtagaaatgatattgaaagctgctttgatggcacctgcttccaaacggaaaaatccctggcaatttgttgttgtggaggataaggaaatgttggtcaagttgtcggcatgcaaaccggcaggggctgcctttctgaaagattgcgcgttggccgtcgttgtgctggcgaatgtgatggaaagcgatgtttgggtggaagatgcttcgattgcctctatctatatgcaattgcaggccgaagacttgggattgggcagctgctggtgccagattcgtaatcggcagacagaagacgatgcggatgctgcacagtatgtgcggggactgctcgatgtgccttaccaactggaagtcttgtccatcatcggtataggatataaggatcaggaacgtaagccgtttgacgaatcgcatctgcagtgggaaaagatacatcttggaactttccgtatgccaactgaaaacaaacaggaggaagcatga

SEQ ID NO: 2814 - DNA, 588 bp, Parabacteroides merdae
aatacgacaatgagtagtaaaaacgatatattatccgctatccgccaccacatcggcaagcgttacgacaggccggaactgacgctggatgccattacttacgaagataaaatcacccagtttacagactctttgaaagctgccgggggacaagctgtcctgatgcagcccggcgacgatatcaacgatattatccgccaccattttcctgatgcaacccggattgcttccaatctgcccggtatcacctgtgctaccttcaatccggacgacctcgatgatccccgcgagttggacaatactgatcttgccatcgtggaagggcatttcggagtagccgagaacggggctgtctggattacccgccaggtaaagcataaggcattgtattttatctccaacagcctggttttgctgatagaccgcaattcgatcgtgaacaatatgcatgaagcctataagcgaacggaaaacatgacatacgatttcggtgctttcatctcaggcccgtctaaaaccgccgatatcgaacaggctcttgtattgggtgcacacggtccggtcggggtgttggtgatgctgaaatag

SEQ ID NO: 2815 - DNA, 501 bp, Parabacteroides merdae
ttgggactcgacattttcttcgccggtatgtccgggaaaagaaacggctttgctgaattggggtggagcgatcctaacaatatggactggaaaaatttctcggcttgtatggtagaccagtttccttgcttgaatatcatgaatgtgaactatcgtattccggacttggaaggatttcattcgacaaatgcatttattggggaggggacggtggagatcacttgtgctgatccgagtgcggatatcgactatacaactgacggaagtgtttcgacactggaatcgtcccaatataccgtatctttgaagattacggagacaacagactttacattccgtaccttccgcccgaacgggaagaaaggtgatatcgtaaagacgcgttatatcaagagtgattacgcttcggtaacggatgtaaccacttctcataacagcttgcaaaccgtatggtatgaattcaaaaggaatacctgtgcagatataaaaaggctccggtga

SEQ ID NO: 2816 - DNA, 1404 bp, Parabacteroides merdae
atggatttcaaattaaatacaggaagttgctgcatgggtaaaaaaggatgcagcaaaatacaaaataataaactgaacacatatgactggctttgtgacgtgcccgatgcggcaaacgcaaccgattacgtggaagtacagtttaaaaacacccgcaaagggtattacctcaacagttccaagatacctctagaaaaaggagatctggtcgcagtggaagctagccccggacatgacatcgggactgtgacgctgaccggtaagctcgtccttctccagatgaaaaagaacaatgttcgtaccagcgaaggcaacgaacctaaaaaggtatatcgcaaagccaaaccgaccgatatcgagaaatacgaagaagcgaaggccaaggaacacgccacgatgatccgttctcgccagatcgctgctgacttgggactgaatatgaagatcggggacgtggaataccaaggagacggcaataaggcgatcttttattacattgccgacgagcgtgtcgacttccgccagttgatcaaagtactcgccgaagctttccgtgtccgcatcgaaatgaaacaaatcggtgcccgccaggaagccggacgcatcggaggcataggcccctgtggacgcgaattgtgctgttcaagctggatgacgagttttgtatctgtagccaccggagccgcccgctatcaagatatctccatgaatcctcagaaattagccggccaatgcgccaagctgaaatgttgcatcaactatgaagtggatgcctatgtggaagcgcaaaaacgtttgccgtcccgtgaagtggtgctggaaacaaaagacaatacctattatcactttaaaacggatatcttcaaacgggaaattacctattctaccgataaatcgttcgcagccaatttggttacgatctctgccaaccgtgccttcgatgtaatcaacatgaacaagaaaggcatgaaacccatcacactcgaagctgataccaagccgcaaccgccaaaacgcgatgcacaggatattttgggacaagatagcgttacccgtttcgatgcatccttgaaaaagaagaaaaagaaacgcaatggaaacggtaacaaggaaaaccagccgaaagaaaccgtagccaacgctgtcagcgaaggaaacagcaaaccttctaacggagaaaaattgaacaacaacggcaacgaaaataaaaacggcaaaggaaacggaaacaagaacggaaaccgcaaccgcaacaacgggaaccgtgataataataacaaccgggagaacaatcgtaacagaccgcgtccgaaccgagtaaataacgataagcaaccgaataatgacaaacctcagcaacaagctaagcctgctgccaaaccggacacaaagccggaagcttaa

SEQ ID NO: 2817 - DNA, 2109 bp, Parabacteroides merdae
tttttatttgccgattattccgtacctttgttatataataaatcaacactaaaggacatgaagcaaaatagcgaaaacccctttttcgggacttatcggactccattcgaaactcccccgttcgaccggatcgaaacagaacattacgaacctgctttcgacgaaggaatccagcaattggacgaggaagtccaggccattgccaacaatacggaacttccaacattcgaaaatacaatcgtagcgctcgaacgtagcggtaagctactggataaagtcagctcgaccttcttcaacgtattgaacgcagaagcagacgacgagatgatgaatatctcacaacgagtatcacccaaattgtcggaaagttccaataatatttatttgaacgaaaaactgttcgcacgggtaaaaagtgtctacgaacaaatagaaaagctacgcctcccgacggaagacacacgcttgctggaaaagacattcgaagctttctgtgtacgtggcgccgcactcggacccgaagaaaaagaaaaatatcgcaaactcagttccgagttaagccttctttccctcacgttcgatcagaacgcattgaaggataagaaccgctacgaactgttgctgacaaaagaagacgagctgaaaggactaccggaaagcatacgcgaagccgccgcgctcagggctaaagaaaaaggaaaaaccggatggctattcaatctctcggccccaagctacgtgcccttcatgcgttactcagctctgcgcgggttgcgggaaaagatgtaccgggaatacatgagcgtgggcaacaaaggggatgaatacgacaataaggaaatcatacggaaaatcgtcaacatccgcctggaaatcgccaagctgatgggacatgccgactatgccgactacaaattgaaacatacgatggctaaaactcccgcacgcgtctataaattgctgaacgagctactggaggcatacaagccggttgcgcgaagcgaatacgaggccgtgcaaggattcgcttcggtaacggaaaaagaaaacataaccatcatgccctgggattggagttattattccgaaaagctgaaagatacccgtttcaacgtgaacgatgaaatgacgcgtccctatttcgaactgaaccatgtaaagaaaggcgtgttcggcctggccacgcaattatacggcatcacttttaaagaaaacaaagagattccggtttatcatcccgaagtagaggcatacgaagtctacgatgccgacgggaagtttctttccatattatatacagacttccatccgcgcgacggaaaacagtcgggagcctggatgaacaatataaaggaacaataccgggatcgagacggcgaagacagccggccgcaaatcattatcgtgatgaacttcacgcgtccgaccgagacgaagccttctttattgactttcgacgaagtcaacacactgttacatgaattcggacatgccctgcacggcatgtttgcagaaggatcatacgcgagcctttccggtacgaacgtctatcgcgactttgtggaacttccttcccaactgatggaaaactggctgacagagaaagagtttctggatcagatcgccatccactaccaaaccggagaaaaaatcccgcaagaattagtacaaaaactgatagacgccgctaatttcaacgtaggatacgcctgctgccgtcaactgagcttcggttttctggatatggcctggcatacccggacagagccgttcggcggggatgtaatcgctttcgagaaggaggcctggaagcagaccgtgatcgtcccggaagttaccggaaccttgatgagcagcagtttcgggcacattttctctgggggatattcagccggctattacggctataaatgggcggaagtcttggatgccgatgctttctcggtcttcaaagagacgggaatcttcaaccgggagacagcccgttcttttcgtgaaaacatcctctcgaaaggcggcaccgaagatccggatatcctgtacagacgtttccggggaaaagatgcagaaatcggcgccctgttgaaaaggaacgggataatacgctga

SEQ ID NO: 2818 - DNA, 855 bp, Parabacteroides merdae
atggcaaaccccagattacccaatataacagagtcggaacaggagctcctgtatgagaagttgaatatttataaccaggggaaagcctcttataaggaggtgggatgttaccttgtggttttaccgagggaagggcatccgaactacagcctgtggttctacacgcctctgctcgacaggcggtgcatcctctttatcgaagacctgaaaccggacattatccagtcgttgcgcatcgtcacttccgaattgtggtatgccaaccgccgcatcctgatcacggactacaacgaaaagaggatgtcgacacacggggacgacctgatcgctttcggcaaataccgcggacatttcctgtatgaaatcctgcggatagatccgggctacgtgaactggatcgcctttaaatatacaccggccatccccaagcaggaacgtttcgtcaaaatggcacaagcctacaactgcgtctacctggacaagatgcttaaaaagaaataccaactacgtcccaccagtcgttttttaggaaagaaaggggacaagctgtccaatctcaccctgaaaataatcaaagtacaggtggaagacgatccatacaggactcatgtcatcgggacaactccggtcttcttcgtccgccagcgcttgacagccatcgatacgagtggcaacctggtcaacctgacttttgcctccggcaatcccagccatgcctccggacagttgccctccctggaacacgcctaccggccgggggaagtgctgcatatctcttcggcacgcatcgccgcgacgtttgagagtcatggcacacagtacacacggctgaattatgtcaagattggaaaataa

SEQ ID NO: 2819 - DNA, 381 bp, Parabacteroides merdae
atgaaaagaaacgtcctgaaccagttcgagtgtaaaacaggaaaagcgggtgagattctatgtaatacggatgacaccggcaacattttattgttcgtctcttccggaaaactggtgatctataatagaaaccagacgcctattgccgatgtgaacgaggggtattttgtattactgcctgccgaaaaatcattcatagcgacagctatcacattgacgcgactcatactcatgcatgccggtccgctttccgaaatgataacagacgatccggaatggaatccagatcgtcctgtcatactccctatctgtccatctttggctaaaaccctatacctaatcgaatattatcaaaatgaaaagcgaagcgaactgaactaa

SEQ ID NO: 2820 - DNA, 342 bp, Parabacteroides merdae
atgccttctgaatgggttttgagtaacgtaaaagacatagccagctctcaatttggaagtcacggcaatcgtacccccatttttggtatgccttcacccgtatccttaacaaagaatttaatctccgtctccaatacctcatacccaaaacgaataaaaccttttttccgtatgcttcatcgcattattcagcaagttagtaattatttacgtaagacggcatacgatccgtataaaaatttatcgcgggacattcttttaactccaaaacaacctttccaggcatacaaagttgcgtcgaactataaatctcatccatcatttcgggcaagtaaatattga

SEQ ID NO: 2821 - DNA, 477 bp, Parabacteroides merdae
gtctattttgttccggcactgaccgggttgggagctccttactgggaccagtatgcccgtggtgccatcatcggaatcacgcgcggaacaagtgcagcccatctgacccgtgccgccttggaaggtatttgctatcaggtctacgatgtcttgatggctatggaaaacgatatacatgccaagccaaaagagatccgtgtggatggtggagcaattgctaataacttcctgatgcaattccaggcggatatctgccgttgtccagtggttcgtcctcgtgtccttgaaacaacggctttgggagccgcctatctggcaggattggcaatcggctactggaaagatgtggacgaacttaaagaacagtggtctttggataatatttttagtgccgaaatgcatgaagaaatggctgaggtcttgcttgccgaatggcataaagcggtcggtaggagcttgaattgggctgcggactag

SEQ ID NO: 2822 - DNA, 1215 bp, Parabacteroides merdae
atggaaaatatagatttcttaggactgttccaaggctttggaacaatggtagccggtggctggctattggctacggcccgtatatttctgatctttttgggcggactgctggtctatctgggctggaaaagcgtgctcgaaccgatggttatgatcccaatgggattgggtatgatcgcaatcaattgcggcacgctgattatgccggacggtgtgttgggcaacctattcctggatccgatgctttccgatacggacgaattgatgaatgtcatgcagatcgacttcctgcaaccggtctatacgctgacgttcagcaacggtttgattgcctgctttgtgttcatgggaatcggtacgctattggatgtcggcttcctgctgcaaaaaccgtttgccagcctgttcttggcgttgtgtgccgaactagggacattcctgactcttccgattgcctccgctatcggtttgaatttgggagaaagtgcttccgttgcgatggttggtggagccgatggtccaatggtgttgtttacttcactcgtgttggccaagcatctgttcgttccgatcacggtagtcgcctatctgtatctcggacttacctacggaggctatccctacttagtaaaactcctgataccgaaacgtctgcgtgcaatcaagatgacaactaaaaaggctcccaaaacttatgatgcgaaagtaaaactggctttttccgtaattttatgtgccgtgttgtgttttctgttcccggtcgcttccccactgttcttctccctgttcctgggtgttgcgatccgtgaatccggcatgaagcatatttatgattttgtcagcggcccgctcctgtatggttcgactttcatgttgggcctgctgctgggagtcctttgcgatgccaagttattgcttgatccgaaaatcctgaaactcttagtcttgggtatcgccgctttactactgtccggtatcggaggcatcataggaggatatatcatgtatttcattaagaaaggtaattataatccggtaatcggtatcgctgccgtaagttgtgtaccgaccacagccaaggttgcgcagaagttagtcagcaaagaaaatcccgattccttcattctgggagatgctttaggtgctaacatctccggagtgatcacctcggccatcatcacaggtatttatatcacgattgttccatatctctga

SEQ ID NO: 2823 - DNA, 561 bp, Parabacteroides merdae
atggacgaacaactgttaatcgacggatgtaagcgtggcgaagcattggctcgtaaagaattatatgaactgtacgcacctgccatgatgagtgtgtgtgtccgttacgtccgtgacagggagacggcccgtgacttgcttcaagatggatttatcaaagtattcaccaaaatacagacctattcggcgacaggtccgtttggcgcctgggtacgaagagtttttgtgacgacggcactcgaatatctccgtaaatatgatgctctccggtcgagcgccccgattgatgaatatggagaacaggttgaagatgtggatacttccgtgctggaccgcctgtcggccgacgatttactggaatgcatctcccggttgcccgccggttaccggactgtcttcaacctgtatgccatcgaaggatatacgcataaggaaatagcggcaatgcttcatatacaggagatcacttcccgctctcagtttgcgcgggcaaggaaagcattacaggaaatggttcaatctttaatagcgcaggacaatgtcagcagaaacagaacataa

SEQ ID NO: 2824 - DNA, 516 bp, Parabacteroides merdae
gaaaacgtagatacagccgtcaagccggctttaggacttgaagtattccataacttcacccttctgcacgacgatctgatggacgatgccgataaaagaagaaacaaaccgaccgtccataaagtatggaatgccaacaccgccatcctctccggcgacgccatgctgatcgcagcctatcaactgatcggcgaaacgaaatccgaatcattaaaagaaatattggacctgttcacccgtacagcgcttgaaatatgcggcggacagcagtatgacatggagttcgaatcgagaaccgatgtaacggaagaggaatacattgaaatgatccgactgaaaacggccgtattgctagcctgcgccctgaaaatgggagccattatggggaacgccccgaaagccgataccgaaacgctgtatcagttcggtatcaacatcggactggccttccagttgcaggatgacctgttggacgtttacggagacacagccaccttcggcaaaaatattggagga

SEQ ID NO: 2825 - DNA, 513 bp, Parabacteroides merdae
atgacaaacctcagcaacaagctaagcctgctgccaaaccggacacaaagccggaagcttaaaggaatcattgccgcattgacgtgttccctgtccttttcctgcgaaaacccggccttatacgaccagtatcaggcgatcaacaatatcacgtgggaaaaggacaaggaatactattttaccttcgaggtgaaagatatatccgttccttacgacctgacactggaagtaaggaacaataacttgtatccctatcagaacttatggcttttctgtagtgaggagcagccaatcggcccgcttcgccgggacaccatcgaatgcatgcttgccgacgaattcggcaaatggcacggacatggcatttccttatatcaaagcagttttcccattcattcgcaatataagttcccgcatgccggacaatatacattcagcttccggcagggaatgcgtgacgatgctctgaaaggaatacaagaaatcggattctcggtccgtctttcccgttaa

SEQ ID NO: 2826 - DNA, 942 bp, Blautia sp.
atgacaaaaaatcatactgaacaaactggatcgaatcttctaactcaccccggtagaacttccgactcttcccccaaaaatactgtttctaaacagatgtctctatctgattctattttatcaggagcagttgtgtcgtatcgaaaggcaggttatacattcggtcgacacttacatactaatattgagatttatcgaattctttccggagaatgttatatggatattcaatcagaaaccctgcattgtacaaaaggcgactttattatgatccttcctgatatggtgcattctttttatctgaatgatacttcagattgcgagtttcagcatatacatttcaaccctgatatgttttcaactatcattcttgataatgatggaatattcccgattacgcttcttcatgctgtattattttcttcacatttttattatcgactcatctctgatgaaacgattgataagcatcttcagaaattgattgatttgcgtacttcctctgacagtctgtttacagccgctaatcttaatgttgctcttatgaacctgatgctctatattcttgatcacacagagcttgtacatgaacgtgaacatgcagagcctcaacttcaaaacagttatgtagcttatacattgaattatattcaaactcattacgctacaaaaatcttacaagaagacattgcacaacaattgcatatttccgtccgttatctcagtaaacttttcaagagttatatgggcgtcacattatcaaactatattaatatttatcgtatcaatcgctccattgagctaatgcaggataccaatttaaccttaacggaaattgcactgcaggttggatttaaagactcgcagcactattccaaagtctttggaagcgttattaatgcaacaccttctcaatacaggaaaacgtttttaataaaataa

SEQ ID NO: 2827 - DNA, 747 bp, Blautia sp.
atgaagaatcgaaagaagcaattcctaaagcttggaatcattctattggcgattgctgttacaggaactgttgccggaatcattcaatataaaaaggcaaatcaattcgatcttactgttgcggaacacgtaattagtaaagaagagtatctgaactgtatgaaggcagttgaatatgatacaaagatacagattcagcaggagtatggcgctatatatgaagatgacttctggaaaaaacagtatgatggaaaacacgggtatgaaattctggcggataatacagtagaagagttgaaacacattcatgctgtttacgatcttgcaaaagaacagggagatatcacagacagtagttatgaagcactggaaaaacgctggaaagatgaaaatgcagagcgaagtgagaaagtagaaaaaggcgaagtaatctacgggcttaaagaatatacgtttcagctttatctggattatgaaatcagcacgttaaaagaaaagtactgtaacgataccaatcgtgaaggtatgaaactgacagaggatgaaatacaggaacactatcaaagccgagagtggatctttggagacagcgatgaaaatgcagaccttgagatggcaaggatcgcggtcgaaagagaactgcgtgagcagaagtatgatgatatgatcacgcagcgtgaaacaggttctcaggtggcaggtaacatggagaatgtaaaccgaataaccttgaagaatatacaataa

SEQ ID NO: 2828 - DNA, 879 bp, Blautia sp.
atgggaaaaaagaaaacaaaattgacattagaaaaaaagtataatcttaccggatgggcgtttttgcttccagcagctattttaatttttgtattttgtttttatccaatggcacaggcaatcctgctttcttttagaaaaacagggggagtgtttaccgggttatcgaattataccagagttttccaggataaaacatttcaacagtgcttgtttaatacgttcttttactttttgatccaggtgccgatcatgcttgttcttgccttgatcctggcacagcttttgaatagtccaaagatcagatgtaaaggtcttttccgtacattgatcttccttccgtgtgcaacatcacttgtatcttactctatgatcttcaagtccttgtttgctccggacggagttgtgaacagagttcttacaggaattggattatcctctgtcgactggttccagagtacatggccggctcgttgggtaattgttatagctttgatctggagatggacaggttacaatatggtattctaccttgcaggattacagaatattgattattccgtatatgaagcaagttatatcgatggagcaacaccatttaagcagtttataaagattacaattccgcttctgaagccaacaatccttatgacagcaattatgtcaacttcaggaacacttcagttgtttgatgagtctatgaacctgacagcaggtggacctggtaagtcaactatgacattggcacactacatctacaatatttcctttgtagagacaccgaaatttaattatgcagcagcattgtctgtatgtattcttataatggtagcaattctgtctgcaattcagatgaaagtaggtgacaaacgtgactaa

SEQ ID NO: 2829 - DNA, 843 bp, Blautia sp.
acgaggaggggaattatgttagaggtattaaaggttatcattttaggaattgtgcaaggaatcacagagtggcttccaatcagtagcacaggtcatttgattctggtggaacagcttattcagctgaaacagagcgaggcatttacgaacatgttcaatgtggtgatccagttcggatctattatggcggtcgtagtaatttatttccataagctgaatccattttcaccgacgaagacggagaaacaaaagaagatgacaattcagttatggattaaagtagtgatcggaacaattccggcactgatcggaggagtgttgctgaacgacctgattgaatcaaaactgagtaatgcatatgttgttgcattgatgctgatcgtttatggtattttattcattataattgaaaaacgtaatgagacaagagaaccgaaagtaaaaagactctcccagctttctgtgaagacagttcttctgatcggagtcttccaaatgatggcgatgatccctgggacatccagatccggagcaacaatcgtaggagcactggcacttggggtttcaagaggtgtggcagcagaatttacattcttcctggcaattccggttatgttcggagcaagtgcactgaagttgtttaaattcggtttggcatttaccccaatgcaggtattcctgcttcttcttggaatgatcgtatcctttgcagtatctgttatagcgatcaagttcctgatgaaatatatcaagaaccatgacttcaaagcatttggatattacagaatcgtacttggtattattgtatttttattctttggtattcaggctttattcaaataa

SEQ ID NO: 2830 - DNA, 807 bp, Blautia sp.
gtgactaaattgaaatcaatagtttcttatgcagtgttgattattgcaagctttctgtctgcatttccactgtattacatgctttgcggagcaacaaactcaagtatcgatgtcgtaagaggtaaactctatccgggtactcacttgatagagaactttaagacactggtaggtatgcagaatcttgggcttgcaatgtataactcattccgaaatgcgatcatcattacagttgtagcactacttgtgtgttcaatcgccggatatggattcgagatttatcatgacaaaggaaaagatactttaatgagtattcttcttcttgcaatgatgcttcctttcgtagccattatgattccgctgtttaagatgtttacttcatggggactggttaatacatggatcgcacttgcgcttccgacaatttccactccgtttatgatcatgctgttcagacaggcagcccgttctttcccgcatgatattatcgaagcagcaagacttgagggattaaacgaatttcagatcttctttaagatgtttatcccggttatgaaatctacttatggagcagctatgactgtaacattcatgagtgcatggaataactacttatggccaacgatcattttacaggacagcaaagcgatcactatgccgatgcttgtagcgaacctgaagagtggttacagtgttgactatggtatgctgatgcttggtgtattgatttgtacacttccgactgcaatcatcttcctgtgcttacagaagagctttgcaaacggaattacaggagcggtaaaataa

SEQ ID NO: 2831 - DNA, 639 bp, Blautia sp.
atgagtacagagacaaagacactaacaaacgcagatgcgaagattcagccgaagctgggggtaaaggcattagttcagatcggaatgctttcagcaatcgcagtagttttgatgatgtttgatattccgcttccgtttgcaccgacattttataagattgatttaagtgaggttccggttttggtaggatgctttgcaatgggaccaatggcaggagttcttgtagaacttgttaaaatcttactgaatcttgttttaacaggaacacaaacagcaggtgttggagagattgcaaactttattatcggatgttcattctgtgtacctgcaggcctcatttacagaagaaacagaacaagaaagagtgcattgatcggaatggtaacaggaacagttctgatgatcgtgattggatgcttcgtcaacgcatttgtattgcttccaacttatgcagctgcattcggaatgccgattgacgcactggttggtatgggaacagcagttaactcacatatcacaagcctttctacatttgttatgtttgcggtagcaccgttcaaccttgtgaagggaattgttgtttcactgattgtatttttaatctacaagaagatcagcccaatcttcagaatcagataa

SEQ ID NO: 2832 - DNA, 1086 bp, Blautia sp.
atgtcatttgaagagaaaatgaaacaggatttgaaaaaagatttagaaattccagagattgtagagcaaaagattcaagatgcatataaagaaatcggacaaggaaagcttagaatgaagaagccagataacaggaatcagaagagaaagaaagtgtggacaacagcggcggcagctgtggcggtgatcgctgtatcaggaacggttctttattccaatccggtactggcgaagaatatcccggtgatcggagatgtctttgcaaaaatgcaggaaaacagggcgaaggatccgtatgcagggaaagataagaccgcctatgaaaagattgaagattattctgcaaatgtgcagactccgggatcagaagcagaagataacggcgtgacagtaacggtatccgatgcatactgtgatggatatgaaatgtattttacgatgacagctactacagacaatgagcagatcaatcagaagaaatatctgctgccggagaaaagtcagagagtgcaggttaacggagaggaatgcggtgcagaactttgtctggaaaaagcggaggacggaagctttgtaggtcttggacatatcagtgcagattttctgaagaaaaaggaattttcagatcagtcaacggtaaacatacagtttacccagctctatggaaagggagaaaatgagctgagcacaaccaagtatgtggagggcgagaatctgatcagcggagagtggaatctcaaattcacagtgaatacggatgccagcaacaaccagacatatgaagtaaatgcggagaataatggattcaaagtaagtaaggttgtaaaagtgccagcatccacctacctttatcttgaggtgccggaaacatatgaaaatgtacagatgattattacggatgcagatggaaatgccctcgagaaattcggaggtacttttacagatccggaacatggagtgtaccagatcaagctgcagtttgagcagacggatacagatcagattcatgtgcaggttgtagatatggatcagagcacgaacgataatctggtcatggttgcagaaatgacagccgatctgaattaa

SEQ ID NO: 2833 - DNA, 891 bp, Blautia sp.
ttgcttaaaaaggatacttcatttctggtagtaaatactagtttgaagtataaagctttacattataaaaagtattatgataaactgaatatcaaactgaaaatttgcggtgtaggagatttcttacaccgcatctgtgttttagaaagtagaggaatgaatatgccaataggagttattatcaataccttgtcggttgcagccggcggtgtgatcggggcattattcgggcacaaattgcccgtgaagtttaatgcagagcttactaagatttttggagtctgcgcaatgggaatgggtgtcagttccattgggcttatgaagaatatgcctgctgttattttcgcagtaatcattggaactgccattggtctggcagtcaatctgggcggaatgattaatagcgcagcgacctgcatggagaaaccagtgggaaaactcttcccaaataagaacaaatctatgtccagagaagagtatatgtcaatgctcgtgacgatcatcgtattgttttgtgccagtgggacaggaatttacggttcactggattccggaatgagtggagatcatacaattttgatttcaaagtcgattctggatttctttactgcaatgatttttggaggaacattaggtatggtgattgtagcagttgcgattccgcagtgcgtgatttttctgatcatatttgcagcagcaaaacttatctttccgctgaccacgccggatatgattgccgacttcaaggcatgtggaggcttcctgcttcttgcaactggttttcggatcgcaaagattcacgatttcccagtcgcagacatgatcccggccatggtgcttgtgatgccggtgagctggttctgggtaaatatgatcgtaccgatgctgtaa

SEQ ID NO: 2834 - DNA, 768 bp, Blautia sp.
atgaaagtttttacttgtaaagatcgtttggaggatattatgacctgcatctatgatgcgtggtctgaagccttacaaattggtcacgaccagatacaattaaagaaagaaccgatatttcagcagacgatatttgatgaatatattcacgtagatcaagatacttccaaggcagaaaaagtgattcgttcgatacgacgagatatttctgatgaggcatatctggatatttatctggcaacattatctgcggaggaagatgcactgcaggcaatttataatttccttcgggtcgggttttcgatgggtggcaatgcattgaagcaatatgcgaatccgcatgtgatgcgaatattagaattacgtcgcaaagtatccaatgaaagtcatcattttagagagtttacacgatttgagaagttgaattccagtaatgtatatgtcagccatctagaaccgaaaagtgatgtcattatgttggtaggcagacattttgcaaatcgcatgccttcagaacagtggatgatcatagatgataatcgtaaaacagcttgtgttcatccaaaagatggtgagaactatcttcgctatctgacagatgaagaatttcagacattaagaaagacagaagagtacaaagatgagtatacggatatgtggaagacattttttcacgcgattgtgatagatgaacgaaagaattatgtatgtcagcgaaacttatttccgctatggaaaagaaaacatgcagtagaattcaaaaaatag

SEQ ID NO: 2835 - DNA, 948 bp, Blautia sp.
atggatttaaaacaattggaatattttgtcacagtaataaatgaaggaactatttcctcagccgcgcgaaaattaaatctctcccagccgccattaagtgcacaaatgaaatctcttgaacaggaaatcggttctcaactctttttccgcggacctcgtcagattgaattaacagaagccgggcgtattctttatgagcgttccaaggatattttagatctttcttcacgtactttacaggaactttctgactatcgtgaaggaaaatccggcgtacttcgaattggtattgtttcctctgctcatgatctgatggcacagcgcgcttttcgtccatttcatgagcaatttcctgaaattcgttttgaattatatgaaaatgacacttatcgtgtcatcgaacaactacaatccaaagttctggatcttgcaattgtacgtacccctttccaatcagataatttaacctgttacactttggttaaagagcacttgcttgctgtcggaaataaaaaatatttttcttccgatacttcttataatacaaaacatacgctttccacggatagaaaaatagctaccgctgaacccgaccaaaatgtaacaatctctcttaaagagttagcagaacatcccctgattgtctaccatcgctggcttcctgttttagaccaacattttgaaacacttaaactgcagccaaactatttatgtatcaaccatgattcccgtacaggaactgcatgggcgaaagccggaatgggaattgcaattctccctgcgtcagctgctgaatcactcacatccaaaaatatcattaaaaaattgatcactgacccggtcatcacctctgatatctgtattctccatcatcctgacggttatctttcaaaaatcggaacatcttttcttatgcacatgatgaattattttggaatttctcactga

SEQ ID NO: 2836 - DNA, 852 bp, Blautia sp.
atgagtaatgaatttatcacccttggctccgccacgagcagtcgcgacgattttagtcttcgctatatttctatttctaaatacgaaggtgactggaactctctaccgcacacacatcagttctcagaactcttctatgttttgcacggtgagggtatcttctatatagaagatgaaaaagtttctatgaaaacagatgatttaatgatcattaatccttatgtagaacacactgaaaaaacacttccaaacaacccaatggaatacattgtatttggtgttgaaggacttgcgttttctttcgatgatcctgaacaggacgcttcaaaaggatatagtttctatagttatggttctgataaaaatcagtttattaattttgcacaattaatgatgcatgaatttcaagaacaaaaacccggatttgaaaaagtctgtcacggattacttgaggttcttttggtatacatttccagaaagcaaaacctttctgttatttctgaatcctctttccagctttctaaggaatgtgcattagctaaacgatatattgatacaaactattcccaaaatattacattggatttattagctgagatcacacatatcaataaattttatctggcacattcttttacagaatgcattggtcaatctccgatcaactatttagcagatcgaaggatcgaagcatgcaaagaacttttgacaacctctgatctctctgtaacacagattgcttccagtgcaggtttctcttcccaatcttatttctcacagatctttaataagaaggttggaatgtcaccaaggcaataccgtaaattatattcacatgtaaaaagggagtaa

SEQ ID NO: 2837 - DNA, 906 bp, Blautia sp.
atgcgaatcaatggaattatcactagaaaaaatggggaaaatcttccccctgccgatacgagtaacattgtatctccaatctaccagttggccggaaatcgtgatgtgaatgacttcgaacaaagcggtgacgacgacttttcttttgctatcccgggattgtcacgtttccgtgtcagtgcatataagcaaagtggtgcgctgtccgttgtgattcgaatcatttccttctctctgccaaatccgactgagattggaatcccgcaacggatcattgacttttctaatttttctaaaggtcttgtccttgtaacgggaactgccggaagcggaaagtctacaacactcgcttgtattattgatgcgatcaatcatcattataggaagcatatcatcacgctggaggatcctctggaattccttcacagacatgacctaagtatcgtcagccaacgtgagatcaacgtcgatacagagagctatgtgactgctctgcgtgtttctcttcgccagcgtcccgacgttatcctacttggggagatgcgcgactacgagactatgcaggtcgcaatgacggcggctgagaccggacatttgatcttctcaacattgcatacgattggtgctgccagcacaattgaccgtatcattgacgtattcccgccaaaccagcagcatcagatcgcagtgcagctatctatggttctgcaggccgttatctcacagcagcttgtaccgacgattgatgggaaaatgatccctgtcttcgagattatgactgtgacacctgccatccgaaatatgatcagagataatcaggaccaccgtccaacgcaacatcataaacttaaggaaaaaatagaaaggaatctgttcgcaggttcctttcattgtgttaaaatatag

SEQ ID NO: 2838 - DNA, 1770 bp, Blautia sp.
gtgatttacttgaagaagaaaacgcttgtgcctctaatcgtttttttactgggcatgtgccttgttagtttgattgtatacaaaacagacgcctttgaaaaagaacagagacacacaactgcacaattaaacgcagcgacctatggagaacgcataaaaaatgagattgtaaatggaactgagattacggatactctggaacaaatcttgatcagtgatgatggaacgatcaagcactttaacacgatcgctaaaaatcttatgtctgattccattgaaagtgtgcagctcgctccacatggtgttgtgacagatatttatcctgctgaaggaaacgaagcgggtaagattgatctgcttcatgataaagatcgtggtgaaatctcctgttatgcaagagacaatcatacagtcattacgcagggaccctttgaattaaaacaaggtgactatggaattgcggttcgcaatccagtctacttaaatgatgaaaacggacaagaatatttctggggatttacgattgttattttgcgtgttcctgagattttttccgactcgatcagtgcactttcaaattttggttatgaatataagctttcaaaaacagacactccctggagtgacacatatgaagttgtttgtcagtcagatggaaatttaacaaatcctgtttcttatgattttacaataggtgaagagaactggagatttgaggttatgcctgtgagtggatggagaaatgctaaacttatagctgtaatcatcggactttatacttctatcgtatttgttctgtcggttcttatctgggtctggttaacagcaaaagaacataaaaacaaattccagaaactagcacatatggattcacttaccaatatttataatcgttacggatttgatgaattagcagaagaaatgatcgctaaaaatccgaacgctccttatgtagttgcactctttgatatagataattttaagtttattaatgatatctatggacatgtttacggtgacagggctttaaagaatcttgctgacagtatgaagagtttttttccatcggatacattgttgggacgaaacggcggtgacgaattctgtattcttctcccaaattgcacatatgatgatgtgaaagaacagttacaacaattcactatgcttccaaagatattctcatgcaagggaaatgactacccgttttatatttctcttggatatgctgaatatcctatagctgcatcaaaccgtgcacagctcatgcgctgtgctgatgctgcactttatgaagtaaaactgcatggtaaaaatggatgtatggcttacagagaaggactccattcaaggagccgcaaacaacttggatttgcactcaaggatatctctgaacatcttcctggtgcgtttattatctacagagcggacaaggaaaatgatgaactcttttatgcaaaccgtgagtttctccacatggccggatacaaagatatagatgagctgtttaagcttacaaagaagagctttcgaaatcttatccggggagatgagcaacagcagattgaggcaagtatctggcagcaaattgacagcggcaatgaaaatgactatattcattttcatcttcgaaaagctgatggaacttacctttctgtacttgatcatggaagaatagtagaaaaccagcaatatggaagagtattttatgtgttgtttatggattgggcagacatgcatatccgttacagtgataagttctctgaataa

SEQ ID NO: 2839 - DNA, 798 bp, Blautia sp.
cctgtgcttacagaagagctttgcaaacggaattacaggagcggtaaaataatgcagcaaaagtattgtataaaacaggaatgtttaaggaaggcgcaaggtgccttccttttagcacataaaatgggattgcttgaggatccttctatggagggacttgaagcaagaagacagaatcataatgaaaagctgaagatgatggagcaggaggagaagctgttctatggaccacgttatttttcagcaccggcgtatttgcagtatgagctgacaagactgaaactggattttgtccagccaagtgaggcggttcgaagcacaggtctgtgtccggatgtcacagagcaggagaagaaagaattttacgaaaaaaatatggatttattcggtcgatatttcggagatctctttacttatgaagaggtagaacagattattgaaaaaagattacgggaggatgcatatgacaagcttatcgaagacgtattacgtgagttcgagacggggaatgattcgaacgatggactgacaagcgaaagtgcattcgcaagtctttttgcaatcaatcatagaagtctgcagccgggagatcaggtactgcttgaacgtggatgtgtatttcatggacagtatcttcatgtgactgatagcggaagcgaagaagcaccaatcgtgatcggagcttatggagaaggcgatgcgccgcgtattgaggcttgtgggcagggaatctggtatcagaattatggagccccattagattcaccaactcatgtatatcgcgggtatgtatcttcc

SEQ ID NO: 2840 - DNA, 915 bp, Blautia sp.
gtgaatgaggtgaaaattgttcgaggaatagattttatagaaggaagcagagaagaagaattacccaattttgaatcaaattttccatatatcgcttcgcgtgtagaactaaatcaatatgcagaagatagtattccatggcattggcataaaagcgtagaagtgttttatgtagagcagggaaaccttgaataccgtacgcctaacggacattatatttttccgcatggctcaggaggcatggttaattctaatgttcttcatacaacgaagccgcaagaagacaatacggtacagctaattcatatttttgatccatcatttattggcggtgaaacaggaaatataattgtgaaaaaatatattatgccaattatcacatctggagaattggatatgattccattatattctaataatttggaacaaaaagaaatattagatcttataaggaatgcatttaatttatcagaaaaggaatttggatatgaactaaaactgcgtgagcgattaactgaaatttggctatcacttttcaaaatgtcattttctgtgattgaaaaaaagaaaactagtacgagagcgaacgacagaataaaattgatgatggtttatgttcatgaaaattttgcagataaaattactgtttctgatcttgcaaaagttggctacataagtgagagagactgttttcgagtttttcaagagtgtcttcacatgacgccgatagaatatattacaaactatcggctgcaaaaagcctgcgatatgttagtacatagcaaagatactatttctgcaatcagtcaggagtgcggattaggaaacagtagctttttcggaaagacctttcgagagcatatggggatgacaccaatggaatatcgaaaaaaatggcggaatagtgatatataa

SEQ ID NO: 2841 - DNA, 1308 bp, Blautia sp.
atgaaaaagaaagtattgagcgcacttttagtagcagcaatgtcagtatctgtacttgcaggatgcggaagcaaagctgacaacaacactgatgcaaagaatgatgcatcacaggaaaacacactgagcgtatggtgctgggatcctaacttcaacgtttatgcaatgaaacaggcagaggcaatctaccagaaagatcacccggatttcaaactggatattcaggaaaaagtatattcagatattgagacagctctgatcacagcagctgaagctgatgattacagcacattgccggacatcttcctgatgcaggattactctttccacaaaaacgttgcaaactattcaggaatctttacagaactgacagattcaggaattgatttttcaaatttctcagcaggaaagttagctgactctacagtagatggaaagaactatggtgtaccatttgataacggtgctacaatcatggcaatccgtaaagacatggttgaggcagctggtcttacagtagatgacttcaaagacacaacatggtcagacttcatcgaaaaagctaaaaaagtagttgagacaaacaatgttccaatgcttacaagctcaggcggatctgagatcatcatcgagatgcttcagtctgcaggtgcttctccgatggtagacggaaaagttgacttagttaataacaaagctcttaagaaagcaatcgagacatacaaacagctcatcgacgaaggaatcatggttgattacactgactgggatcagtacatcgcttctatgaacaagggaacagcagctggtgttatccagggatgctggatcatgtcttcaattcaggcagctgacgatcaggctggaaaatggtctatcgtaaacatgcctaaacttgatgatgttgagggtgctacaaactacgcaaactgtggtggagcaagctgggcagtatcttctaactgcaagaacacagaccttgcatatgacttccttaagacaacattcggtggaagcgtagagttatatgatgatcttcttccaaacgctggagcaatcgcaagttacttaccggctgctgagtctgaagtttacaatgagacatctgatttctacgctggacaggctgtatacaaagacatcgtagacttcgctggaaaggttcctggaatcgattatggcgcatactactcagatgttagaagtgcattaacagatgcaatcacaaatgttgttcagaatggcgctgacattgacagcgagatcaagaacgctcaggatacagtagaatttaatgttggtgagtaa

SEQ ID NO: 2842 - DNA, 1359 bp, Blautia sp.
atgagtaatgaaataacgaaaagacgaaagcgaacaattgaaatgactcagggatctctttggaaaaacatgtttttcttcagtgttcctcttatgttttcccagattttggaagtgatgttcaacttaagtgacgtcgctgttgtcggacattttgcagattacaaagcacttggttctgtcggctcgaccactacacttgtcacactgttcacaggacttctgatcggacttggaagtggtgtcaatgtccaggttgccaacaaactcggtgccggtgatgagaaagctacaaaagaaaccattcactccgcactgattatttgtgcagcagcaggtatttttgtctgtctgatctgtctgctttttgcaggaccaatgctttccatgataaatacaaagccggaactgctcgatcaggctgttctctatatgaaagtttttgcacttggtatgcctgccacggcaatttataatttcggtaacggtgtcttaagcgcccgtggggatacaaaacgtccaatgtattaccttgcatttgccggaatacttaatgtcatattgaatctgatctttgttatcgtattccatatggctgctgtcggagttgccactgccagtgcaatcgcacagtacgtttcaggaggattgatcctgatccatctaatgcgccgcgatgatatgtgtaaagtcagcctgcgtaaattacgctatcataacatttatggaaaaggaattctttatctcggtgttccatcgggtctgcagaatgcgatcttcgcgattgcaaaccttttcgttcaatccggtatcaactcttttgatgcgatcatggtttccggaaatgctgccgctgcaaatgcagataatctgatttacaatgttatgtttgccttctacgtggcctgttccagtttcatgagtcagaactggggagcagggaataaagagaggatgaaaaaatgttatttcgtagcacttacctattctttcagtgcaggactgattctcggtggatcactcttcttcttcggacggccattcttgtctctgtttgctacagagtcggccgttattgcagcaggtatgcatagaatcaggattatgggattctcctatgcattcagtgcctttatggactgtgcaattgccgcttccagaggaatcggcaagagtattgctcctacatttattgtaatcatgggatcctgtgtatttcgtattatatggatctatacggtatttgcttacttccatacaatcccatctctgtatctgctgtacatcttctcctggggactcacagcaattgcagaaaccatatactttaaagttagtttcaagaaagtgcttgcataa

SEQ ID NO: 2843 - DNA, 900 bp, Blautia sp.
acaaatatgatatgcggagtaaaaactatggttataaatgagaattgtaaagtatgtcagataaaacgaaatattgataagtacccactcaatgcgactgaagaagaaataaaagaataccaacataaagtgaaagaaattgtagaaaatagtgacggattatctacacctcaggttgcagaaaaaatggatgaccttcggcgaaagatttttggaaatgtaatagattatactgaaatcaaacagcattataatcaattaatgctcgattactttccgtatatgaaaaataaagttgatacatctgaaaatcatttaaaaacagcaatacagtatgcgatggttggaaactatatcgatttcggagctttagaaaatgtaaatgaaggtgaactgaaagttcaattagatgaagcagtaaatataactatagattctaagctgttagatgtatttaaaaacgatttggtcaatgcaaaaaggctggtttattttactgataactgcggagaaattgtaacagataagttattgatttcaacccttcgcgatattaatcctgatttacatataactgtgattgtaagaggaaaaccggttttaaatgacgccacattggaagatgcgaaacacattcacatggaagatgttgcgcaaaaggtaatcggaaacggtacaggattgccgggtaatgtgatcggagcaatatcccaagaagcaatgacagaggtagagaatgcggatctgttaatttctaaaggtcagggaaattatgaaggattaagcggttgcggattaaatatctattacctgttcttgtgtaaatgtgagatgtttatgagacgatttggtgttgaacagtttacggggattatgacaagagaatgtaatgaaaagtaa

SEQ ID NO: 2844 - DNA, 1266 bp, Blautia sp.
gtgagttcgaagacaggaaatgattcgaacgatggactgacaggcgaaagtgcattcgcaagtctttttgcaatcaatcagagaagtctgcagccgggagatcatgtattacttgagcgtgggagcgtcttttacggacagtatcttcaagtgacagacagtgggagagaagatgcaccaatcgtgatcggagcttatggagaaggcgatgcgccgcgtattgaggcttgtgggcagggaatctggtatcagaattatggagccccattagattcaccaactcatgtatatcgcgggtatgtatcttccgcagttctgctgtatgatgcagaatatatcatcgtagaagatctggagatcacaaacgaagcagacaaaattatcggcgagtactattcccttggagacaagatgaaccgtacaggtgttgctgttgtagcaaaagacaaaggtgtacgacacggtatcacattgcgtaatctgctgatccatgatgtgaatggtaatgtatatgataagcacatgaataacggtggtatctatatgacagcacttcgtccggagaacgaagaactgaccggagtagcacgttataaagatgtcacagttgagggatgctttgtgtatcaggtgagccgctggggaatcgctgttggttatacttatgcacatgacaagttccagggagcagagcttgatgaagaaatcttcctgaaatatggtcacgaaaatatgctgatccgcgataattatgtaaaggcagcaggtggtgacggcattacatcgatgtatgcacttcgtccactcatagagcacaatatgacagattccatcgcctgtgagatcaatgatcggatctatagcgagccgggtaatcgcctgggaaaggtggcagcagctatctggccttggaagtgtaaggatgcgttgttccgatataatgaaggcactgatacaagattgaatcaggacggtatggcatatgatgcagattccggtgacggaaccgtttatgagtataattacagcagacagaacgaaggcggatgtgtgatgttctgtttgcaggaagcaattcataatacgttccgtaacaatgtcagtttcgatgaccttggaggaacgatcagtccggcagagaacccggatgcacggatcaaagataatactttctatgtaagaaaaggcgttccgttcgttcgtaaaaatatggatggcggtaattatacattagagaagaatcagattgttgatttggaaaactaa

SEQ ID NO: 2845 - DNA, 1545 bp, Blautia sp.
ttgtataatgaaaatatgaatacagatattagaaatagtaattatacaacacaggaaaagctgcagattcttgctgatgcagcaaaatatgatgtggcatgtacatcaagtggatccagccggcggggaaagaaaggagagctcggcaatacagaggcatgcgggatttgtcatagttttgcagcagacggaagatgtatttctctgcttaagattttaatgacaaatcactgcgcttatgattgtaaatattgcattaatcgtaaaagtaatgatgtgaagcgggcgacttttacgccagaagaaatatgtgagcttacggtagaattctataaacgtaattatatcgagggactgtttttgagttccgggatcttaaagaatccgacttatacaatggagaagatgtgcgagacattattgctacttcgcacgaaatatcatttcaatgggtatgttcatatcaagacgattccgggagcctcagatgaactgttggcagcggcggggtatcttgcggatcgtattagtgtcaatcttgaattgccaacagaagaagggttacgtacattggcaccgaacaagaccatgccgaatattttgaatccgatgggaaaagtccaaagcacaattgcatctcacaggatggcgattggaaagtctgcatatatggagcgtagcggtggaaataaatttttagataccgggattttttcagatacttcgaaaaagcagttttctgagtggttagatactcagacgaataatacagcaatctctcaagatcctgagatgaagcgattagaatcttatagaagatatactacattggatcatgctttaacatgggcaaatgcgaatcaattagcaccacgtgatatgtcgcaattaaaacgtagttttgctccggccggacagagtacccagatgatcattggcgcgaccggtgagagtgactatacattattgcagacaacacaggcattatatcaaggctttgatttgaagcgtgttttttattcagcatacattcctttgaacgaagacaatgtattgccggagataggaacaccacctccgcttttgcgtgaacataggttgtatcaggcagactggcttcttcgtttttatggatttcatgcaggagaactattatcttcggaacagccgaatttcaatgagatgcttgatccaaagtgtgattgggcacttcgccatttggagcagttcccgatagaagtagaaaaagcaaattatgctacactgcttcgagttccgggaatcggaccgaagtcagcaagccgtatcacttatgcaagacgctacggcagacttgattatgaaagcctgaagaagatgggagtagtactgaagcgtgcacattactttatcacttgtggtgggaaacagatgtaccatactcctattgagacatcttatattacacgacaactaattagtgtagacaagaaagatatttggaatacacaacatgcgaatgagtcattcaaccagatgacgttgacagattttggagtatgctaa

SEQ ID NO: 2846 - DNA, 1572 bp, Blautia sp.
atgggaaattatttgaacccggatattagtacttttgcaagagttgtaaattcagaaatatatgttgataagacgggattgattgaatatacaaatagaagtgctaaaacattacaaagttatatttgcatcagtcgtccacgccgttttgggaagtctattgctgcgaatatgctttctgcctactatacgtgtgagtatgattcaagggagctgttctcaaatttaaaaatagcatcatcagatagttatgaaaagcatttgaataaatatgatgtgatctttcttaatatgcaagaattcttgagtcaaagctccaatgtggaggaaatgcttagcttgcttaaaaagagcgtaatatgggatttgttagataaatacccggatttccgatactttgatgaaacaaatttaatgagaactcttcaggatatttataataagacaaagagaccgtttgttgtaattattgatgaatgggactgcattttcagagagtatataacagataaaaaagcgcaggaaaagtatctggattttctaagagatttattgaaagacaaaggatatgtcgcacttgcttatatgacaggaattcttccaataaaaaaatatggcacacattcagcgttgaatatgtttgatgaattttccatgattgatccgggaccattggcggaatatgtcggatttacagaagaagaagtaagcgagctgtgtgaacgatatggcatggacatgcaggagctaaaaagctggtatgacggatattcttttgaaggagcaccttctatttatagtccacgttcagtagtaagctgcatgcgatttgggaaatttggaaattactggaatcagacagaaacgtttgaagctttaaaaatgtatattgatatgaattttgaaggattgcgagatgacgtgttaagcatgatcgccggggaaagtgttccagtgaatacaggaagttttacaaatgatatggcaacatttcatacagaggatgatgtacttactttattaatccatcttgggtatctagcatatgactatgataataaaacagtgaaaataccaaataatgaggtgagagcagaatacgtcagcagtgtttccgtgtcggattggggtgaagtttctaaagcattgaaaaattcggcagatacattgaatgctatttggcagaaacgtcctgtacaagtggcagagggaataagacaagcacattttgagacatctcatttgcaatataacgatgaaaatgcattgagttatacgatatcacttgcgttatatgctgcaagaaacttttacactgttcacagagaattggcgggaggacaaggatttgcagatcttgtatttcttcctagaaaaaaattccaggaaaaacctgcacttgtggtagaacttaaatggaatgaaagcgcaaacggtgcaattgaacagattaagaagaaagaatattgtaaaagtttagaggaatacaaaggaaacatacttcttgtaggagtaaattacaataaaaaaacgaagaaacatgaatgtataatagaggaagatattaagtaa

SEQ ID NO: 2847 - DNA, 465 bp, Blautia sp.
gtgatctcattctttcctgttgtgatctttacattttttgtttcagcatctactgtatatccgtcaattgcttctgcagccggtaataagagctctgcagacaaattcactgcacatagtacaaattattataaagcatcgaatcaggcgaaagagattctagatcagattgatggaatccttgcgaagtcctatcagatctcccctgattccagctcttatttttctgaaattgaagcaatgcttagtgaatcggatatggatgtgaacttaaacttttctatagaaattaattcagctactcttaattacactactactgttgacgactcacaggctcaggaagtggatttaacactgaatgatccatggacgacttcctccggattctatacgatcacatcctggaaggaagtagcaaccaatgcgtgggatgccgacaactctatgaagctgattcaataa

SEQ ID NO: 2848 - DNA, 546 bp, Blautia sp.
gggaatccgttggaacagataaggttttcaactccgatcggaagaagaaagaagaaacagatgcgcaaataccgtgcagtgataacattagaatttgttgtcctgatcgtacttattatggtgttattctatgctttgatgggaatttcaacagtgcagggaaactctatgtatccgatattgcacagtggtgagaaggttgtgtataaccaaagagtcagtgattataaagccggagatgtgattgtcttgaaaagaccggatggagaagagtttgtgaagcgaatcgtggctgtggccggggatactgtgaatatacagaacggcaagctgtatgtgaacggagcagaagaaaagcaggaaggaacgcttggtgagacactgactgaggaaaacaatcaagtaagctatccattgacggtaggtgatgaccagatcttcgtactgggagataatagagaagtgtccgacgattccagagcgtttggagttgttgatatggatgatgtgaagggaagaattgtctggtatatgggacgactgtag

SEQ ID NO: 2849 - DNA, 1809 bp, Blautia sp.
ctgttttatgaaattttgcttggctctgaacagttacaaataaagagggggatttttgatatgaaagatgtagcaacaatgaaggaagaactaaagaaacttattgacacggcagcaggacgagttccggcagatctggtgatcaaaaactgtaagattgtaaatgtattttctggaaaaatccaggaaggtgacattgcattttcaggtaatcagattgcaggtatcggcgcgtatgaaggtaagaaagtcattgatgcagaaggaagatatgcggcacctggatttatcgacagtcacatccatattgaatcttcttatgtaagtcctgaagagattggacgcatgttagttccacacggaggaacaaccattatggcagacccgcacgagattgtaaatgtatgtggaatcgccggccttgactatatgatgagagcagctgagaatacagtgcttgatgtgaagtatgaacttccatcttgcgtaccggctacaccgttcgagcacgcaggtgcggtgatcgacgcagaggctatgaaagagccgattacaagagaaggaattgccggacttggtgagttcatgaatttcccgggtgtgatcaatgcggcagacagtgatctggataagatcattgtagcaaaacaggaaggcaaatttattgatggacatggaccaggaatcacagggaaagaattgaatgcatatgccgctgcaagaatcgcagcagatcatgaatgttctacagtagaagagatgaatgaccgtctggaaagaggaatgtacattcttctccgtcagggttctgcatgtcacaatcttcgcacattgatcaagggaatgacagcagagaacagtagaagatgcctgctctgttctgatgaccgtcagccgaagacaattcttcatgaaggacatctcgataatcatctgcgcatttgtgtggaggaaggtcttgatcctgtgacagcaatccgtatggcaacacttaacgcagcagaatgctttgacctgaaggacagaggagcaatagcaccgggctatcgcggagatgtagtacttttggatgatctgaaagatttccatgtaaaccgcgtgtttgtagaaggtgagctggtagcagaagaaggaaagtatctgccggagattaagaaatgtgatattgcatctgttaaaggcagtgtgatcgtaaaagatttttcaaaagagaaatttaaaatgcatctgaaatccaataaagtgaatgtgattcagattctcccgggtggagttgtaacagcgaaagatatagcagagattgaactggatgcgaatggagagtttgtgagaaatccagaggttgatcttgtgaaagtagctgttgttgagcgtcatcaggggacaggaaatgtagcttgcggattcttgaaaggatacggaatcaaagaaggagctgtagcactttcagtggcacacgactctcataacattattgttgttggagtgaatgatgacgagatggaatttgccgtaaacagtttggttgagcaggaaggtggaatcgttcttgtaaaggaaggcaaagtgattgagagcatgccaatgccgattgccggtctgatgagtgatcagagtggagaatgggtagatcagaaattaacagacattcacgaaaaagcatacgaagaacttggaatctgtggagatgtggagccggtaatgacactgtgcttcatgtcacttgcagtaattccggagattaagctgacggatatgggattgtttgatgtgacaacattttcattcattccggtggaggccgagtaa

SEQ ID NO: 2850 - DNA, 2208 bp, Blautia sp.
tactttagtcgtgagataagtaagaataaaagttatttggaggggaacatattgatgacgggaagattgacgctgccgacagatgcagatgttattgacgagacattacgattaaagaatctcttgggagcagatgcgttgagagattgtgacggaacagagatgccagaagaacttctgtcagagccggttaagaaatacgctacttattatacaacaagaaaagataatgagtgggcaagtgccaatccggaagaaattcagcaggaatatttgatcagtaaccgtgtgacagcaagaggcgaaacacttcgtattcgcttaatggaaggatttcacacagagcagctgaaagtaaatacgttagatgatccaaaacgttggtgggaagtgatcgaccgtacaactggagagattgttcctacagataaatgggaatttgatgaagcttcaggagaagttgagatccagacaaaggcatatcatgaatatacagtaagctttctggcattccttatctgggatccggtacatatgtataacttcattacaaatgattggcaggatacaccacatcagttgacatatgatgtaagacagccgaagacacagaagtatgtaaaggaaaagctgaaaagatggtgtgaagagaatccgaatatagatgttgttcgatttacaacatttttccatcagttcacattaacttttgatgatcagaagagagaaaagtacgttgagtggtttggatacagtgcaagtgtaagtccatatatcttagaaaaatttgaaaaatgggcaggatataaattccgtccggaatttatcgtggatcagggatatcacaacagtatgttccgcgtaccgagcaaagaattccgtgactttattgaattccagcagattgaagtttgtgcactcgcgaaagagctggttgatatcgttcactcttatggaaaagaagctatgatgttccttggagatcactggatcggaacagagccttatggtaaatactttgcaggcatcggacttgatgcagttgtaggttctgttggaagtggtgtgacacttcgtatgatttctgatatcaaaggcgttgattatacagagggacgtctcttaccatacttcttcccagatgtattctgcgaaggcggagatccgatcggagaagcaagagacaactggagaaaagcaagacgtgctcttcttcgttcaccattagacagaatcggatacggcggatacttaaaacttgccagtaactggccgggattcattgatgagatccagaaagttgttacagagttccgtcagattcatgagaatatgcagggaacaccttcctatgtagcaccatttaaggttgcaatcctcaactgttggggaggactgagaaagtggatgtccaatcaggtacatcacgcaatctggcacagagagacttattcagcagaaggtgtgcttgagtgcttaagtggtatgccattcgaagttgaattcatctcctttgatgacgtgaagaaaggtattccggaagacattggagtaatcatcaatgtaggtgatgcatatacagcatttagtggagctgaaaactggatcgatgaagaagttgtaacaaatattcgtcgctttgttgacgagggaggcggattcatcggagttggtgaaccgacagcatatcagcatcagggaagattcttccagctgtcagatgtacttggcgtagatcgtgagatgtgtttctcacttaatacagataagtataatgaattagatgcaaaccactttattttagaggatattgaaggtaaaatagattttggtgagggaacaagccgtgtctatgcacagggcaagaattaccagatccttgcaatggatggagagtacagccagatggttgttaatgaatatggaaaaggacatagcgtatactttgcaggtcttccatattctccacagaactgtagaattcttcttcgtgctatttactatgcagcaggcatggaaaaagagatgaagcattactatgtaacaaatgttgatacagaagtaactgtattcccgaagagtaagaagatcgcagttattaataactcatcagaagcgcgacacacagatgtatatatcaatggcaactgtgtatatgaactggatttagagccaggcgagatgcgttgggtagatgatgttgaataa

SEQ ID NO: 2851 - DNA, 546 bp, Unknown
  Description of Unknown: Ruminococcaceae sequence
atgtatcgcgctctccggcgcatcatgagctccgccaccatcttcgggtattttctcgaggtcgttcccgtcacctgccttgtcggcatggtctatgccatttttcgcctgcgtgccctgcgccggagcgatcgcatcgcgtggggcgcggagatcatgcagtttctgttcgtctgctatctcacagggcttttgggccttttgcttctcccgcccggcttctggtgcagcatctttgacggcatcgccttcggctggtggagcgaggtcaagcctgtcttcggcctcggcggcgtcaatttatcgcccacgctgctgcagtgcctgcgcggcgagttgacgctcgggagctgggtgaaggagatgctgctcggcaacatcctcatgttcctgccgctcggcttctttctcccctttgtgacgcggcgcgtcaacaggaagaacatttttgcatttgctctctgcgtgccccttgtccttgaatcgctgcagatcgttctgggccggtcgttcgatatcgacgatcttctctgcaactttctcggc

SEQ ID NO: 2852 - DNA, 918 bp, Unknown
  Description of Unknown: Ruminococcaceae sequence
aaaaaattccttgcgatcctgctggcgctcgtgatgacgctggcactggtcgcctgcggtcagcagaacgacgctgacaacagcgacagcacggacaacgagcagcccacggagacggagttccagtccaacatcctcttctgtggttccacgtccctgtaccccatcatctcttccctcgcctcttccttcacggaggaatatgtgaagtggaatgcggtggacccctctttccctgagacgaacatctccatctatgttgctcccggcggctccggcgtcggtgtcagcgccgccatcgacggcacggctgacttcggcatgatcgcccgcgacatcaaggattccgaggtcgaggcccttggcgagaactacagccagtacatcgtcgcccgcgacgcgctgaccgtttccgtcaacgcttccaaccccatctgctccgtgatggatgatatgtccaccgatacgatccgccagatcttcgccggtgagatcaccacctgggatcaggtcgactcctccctgcctgccgagaccatcaatgtctacatccgtgacctgtccggcggcgcttacgaggtcttccagaaggccatcatgggcgagagcgaagtcaccgcttccgctacccagtccgcttccatgaccgaactcgccaccaacatcgcaaacgatccctggggcatcggctacgccggcttcggcgcttacaacaaggccaatgccgacggtcaggtcctgttcgccatgaaggtcgacggtattgaggccaacgaggagaacatcatcagcggcgattacaccgtgcagcgtcccgtcatgttcgtcaccggcgcacctgtcaccgagtccgagcaggcgttcatcgactacgtcttctcccagaccggctatgatgttgtcgtcgccaacggctac

SEQ ID NO: 2853 - DNA, 867 bp, Unknown
  Description of Unknown: Ruminococcaceae sequence
gacacaacgcttgccgacaagggactgatgcgcgtgagcggggaagaggacgtgaccgtcgatctgaagctcaaatttccgcgcaggctcgcctacagcttcgacacgagtcagatccgccttgtgtgcgatctttcctccgtcacctacgcgggcaagcagtctgtgagctataatattcttctcccaagcggcgtttccacgcgcgatgtatccgtggaatcgcccacggtgcgcacggtgcagatcgaaatcggcgagctgagtaagaaggacattgagatacgctgcaacgtggtgggcaatgtggccgagggctacatcgccgggaccgttgagctgctgcccgaaacgctcgaggtgcgcggccagcagtccgacatcatgcagatcagctacgcgcaggtcacgctcaacattgagaatgcgacctcgacggtcgtggaactgctcgattacgagctgtatgacttcaacaatcaggtcatcaacagcaaaaacatccatcccatgagcgacaatatccaggtcacgctgccggtgctcaaggtgaaggacgtgccgctgacggtgaacttcgtcgaatccgcgggctcgcggcttgaaaattacacgtgggctctcagccacagcagcatcactctttcgggcgacgcctcacagatatcttcgatcagcgagctcgtgctcggcacgcttgcccttgaggacctgcgcgggcaggagactttcacctatgacatccccatccccgatgacgtcaacaacctgagcggtatttcgactgtcacgctgacgatcacggcaaaagatgtggagacccgcgaggacgaggcgttgaacttcagctatgagaacttcagcggc

SEQ ID NO: 2854 - DNA, 696 bp, Unknown
  Description of Unknown: Ruminococcaceae sequence
ttgcagcagtatcttgagcggcaccgctttctgaagggcgcttacctgatggtgcggcgctactttgaccatcacgtcgggcgcgacagcgcggcactgacgtattatattcttttcgcgctcttcccgctgatgatcttcttgagcaacctggtcggtatgatgtcgttcgatatcagccagtttttgaaagggttgcacaccatcatgccgcaggaggcgctggatatcattgagcagtatctcacctatgtcagccgcgattcgagccggcagttactgtggttctcgctcgttttttccatttactttccgtaccgggcggcaggagcgctcatgggctcggtccgccgggcctacggtgaaaaagcgccgacgaattttctgcgctaccagatcaagctcctgctctacacgctgagcctgatcctcatcattatcatttccatcgcgctctcggtcgtgggcgagcgggtgctgaatttcgtttcgggctatatcagcaattatatcaccatcaccttgaatgaccggacgatccgcctgtggtcgatccttcgcttcgcgctgctcggcggtatcgtgtttttccccatcgcgctgatgtacggccttgcgcaggaatcgcacaagatgaaccgcatctggcccggtgtcgttttttcgatggcgatgtggctgacgctttcctacctc

SEQ ID NO: 2855 - DNA, 618 bp, Unknown
  Description of Unknown: Ruminococcaceae sequence
atgagtgaaacggaaatgacgacgctggcgcgcatccatgccgccgcgaaggaagaattcctgcagaagggcttccaaaaggcatcgctgcgcaatatcgtaaagcaggccggcgtgacgaccggcgcgttttacggctattacgagagcaaggaggcgctctttgacgcgctggtgtgtgagtactatgagcacgtgatgggcgagtatcaggcgacgcttgaagcgtttgcagagctgcctccgcaggaacagcccgagcagatggacaagctcagcggagactgcatgaaagagatgctgctctatatgaccgagcaccgggacgcgtttcatctgctgctgcaatgcgccgagggcacgcgctatggcgcgatggtcgacgatgcggtggcgctcgaggaggatgccacgcaccgctattatgaagtcttgggcaagctgggtcatcccgtgccgcatatcgatgcacggctggagcacattctggtcacgggaatgatgaacgcttatttcgagatcgtccgccacgatatgccgcttcccgacgcgatgcgctaccttgaagagctgcacgcgttctacatcgcgggctggatgaagatcatggggcagtaa

SEQ ID NO: 2856 - DNA, 579 bp, Unknown
  Description of Unknown: Ruminococcaceae sequence
cgcaccttgcagagcgagctcgaccgggccgccggtctctgccatgccgtcggcgagcgtgaggcgttcgagactcagctcgcacaaaagcgcgaagcgctttctcaggcacaggcagaatacgatgccatcgccctcgcgatggataccctgcaaagcgccaataccgcgctgcaaagccgcttctctcccacgctcagccgccgtgcgggcgaacttttctcccgcctgacaggcggcaaatacgggcaggtcctgctcgaccgagatctcagcgcgcaggcgggcgagtcaggtgagatcgtcgcacacgatgcacagctcttgagccttggcgcgctcgaccagctgtatcttgccgtgcgtcttgccatctgcgagactgtcctgcccggcagcgaccctatccctctcgtgctggatgacgcactcgtccgcttcgacgacgcgcgctgccgcgccgcgctcgacctcttatatgaagagagcaaaacgcgtcagatcctgctctttacctgtcagcaccgtgaagccgcctacctcttagaccgcagcggtgtcacgatcctcagcctgtaa

SEQ ID NO: 2857 - DNA, 720 bp, Unknown
  Description of Unknown: Ruminococcaceae sequence
cggctcctctttgaatatgtccgcagcgccatcggccttcttgaaacgggcgaggacaagctccaacagacgcgcacgctccaggccggcacgctcgtgctcggcgcgagcgacaccgtgacgagccagttcctactgccgtatcttgacgactttcaccgccgctatcccaatatccacatccgcatcatcagcggccgcagctacaaggtgctcggcctcctgcgcgccggccgggtcgatatcgcctttgccagcgctcccggcgacgcggacgacttagagcacgtcccatgcctgcaaacgcacacctgctttgtcgccgcgccggactatccctgcaacttttcccattcctacacaccggaggagatcgccgccttcccgctcatcctgctcgagcgcaaagcctcctcgcgcacgtatctggaaaagtactttcttcaaagcggcgtcaagctcacgcccgagatcgagctcggcgcgcggagccttcttgtcgaccttgcgaagatcggcttcggcgtcgcgggcgtcacgcgcgaatttgtccagagcgagcttgcgcgcggcgagatccgtgagcttgcaacatcgttcgccatcccgccgcgcagcgtggacctgtgtatgctgcgcaatgtgccgcccagtgccgccacccagcgctttgcgcaggacctgcttgaaaaaatgcagggcatcccgcattctgattaa

SEQ ID NO: 2858 - DNA, 987 bp, Unknown
  Description of Unknown: Ruminococcaceae sequence
atgatagagaaaatagcagtctgccaatttagaaagaaggtttttatgaaagacgacgacaacagcatcctgcttctggaaaagggcaagcgcggcctgctgcagatcatcttcggccgcacgggtatcatcatcgtctcgctgatcgtgcagatcctgttcctcttcctcgctttttacaggctcgaaggggcgatgccctatttctggggcggcaatacgctgctctcagcggtcatcgtgctctcgctcttcggcaatgatgataacccgaccatcaagctcacatggttcttcatcctctcggtgctgccggtcttcggactgatcctgtacctctacatccgcaccgacctcggccaccggctgatgatccgccgttataacgacattcaggcgcagacgaaggacctcattccttcccccaccgcctgccaaacaacggacttgcctccggaaacgcaggggcttgccgcatatctggagcactgtggtttccccgcctatcaaaatacagacgttgaatacttcccgctcggcgacgacgcgttcggcgtgatgctcgacgagctgaagaaggccgagcacttcatcttcctcgaatacttcatcgtgagcgagggtcatatgtggggccgcatccttgagctcctcaccgagaaggtcaagcagggcgtggaggtccgcttcatgtacgacggcacctgcgctgtggcgctgctgccctattcctatccggaaaagcttcaaaagctcggtatcgcgtgcaagatgttcgctcccctgcgtccctttgtctccacgcattacaactaccgcgaccaccgcaagatcatggtcatcgacggcaaggtcggcttcacgggcggcatcaacctcgcggatgagtacatcaaccgcgtcaagcgtcacgggcactggaaggacacagccatcgccctgcgcggcgacgccgtgcgaagcctgacactgatgttcctccagatg

SEQ ID NO: 2859 - DNA, 636 bp, Unknown
  Description of Unknown: Ruminococcaceae sequence
tttctgagcgtggagaacggcagcgcgttcgcaggtgacctgtcgcgcattgaaaaactgaagcgccaaggcgtctgcgccgtaacgctgacgtggaacggagaaaatgagctcggttcgggcaatgtgacggaccgtggtctgacggactttggccgcgccgccgtgcgcgagatggagcgctgcgggatattggtcgacgtctcgcacctcaatgacgcgggacttgaggacgtattcgagacggcggaaaagccgtttgtcgctacgcactccaacgcccgcgcgatctgtgcgcacaagcgcaacctgacggacgcgcaggtgaaagagatggtgcggcgcggatgcctcatcggcctcaactattatggcgttttcctgcgcgatgacgggaatgtacgcagccttgatgacctctaccggcacatcgcgcactttttcgacctcggcgcgcagaaggacctcgcccttggctcggatttcgacggcgcggacctgccggagtgcctttcctcgccagaaaagattgcggaggtttacgactatctgctctcacgcggtttgacgcagcaggagatcgacggcatcttctatgataacgcccgcgcattcctgcgcgcgaatctgcgctga

SEQ ID NO: 2860 - DNA, 582 bp, Unknown
  Description of Unknown: Ruminococcaceae sequence
gtggcacgtagagacgactatttcgtgctgggcgtttttctcatcatgatcatcaaggaggacccccagcgctggcacaagggcgaccggcagggcaacgcgttcttcctcgtgctgctgttcagcatcgccaatgtcgtcatcgatatcgtctcgtcgatcgccatgaaccagagcacggaatggtggatgtatgaatacgcgatgacgctgtatgtggcgagcatgccgctgctggcagcggtgtgggtgtgctatgaatatgtgctcatccactgcgacgaggggcaccgcaccatcatgcgcggcatcgttggcatcgtgtttccgtacctcatctttgtcgccatggccgtcacgaacctgcggacggagtggttcttccacctgacaaacgatatgcagtattcgcgcggcgcgctcttcatgcccgtgggcgtgggctttatcatgttctattccaccgtgggcctattgcaggcgctggtgcactggaagcacatcgttccgcgctcggacgccgtattgctcatcgcttttttcgccaccacggccgcatttatctggatccagctcgcgaac

SEQ ID NO: 2861 - DNA, 546 bp, Unknown
  Description of Unknown: Ruminococcaceae sequence
atcggcaccgagcagctacacctgaaccacaccgagctctccgtctatgcccgccgctgcggcatcgagctcaccgatgcgcagatcgacacgctgctctattcgagcgagggctggttctcggccatttacttaaatctccgcacgctctccgagcgcggtgcgctgcccgaccgaagctcggatatctacgcaatcttctccgcggcgatgatcgacccgctgccgccgaagcagcgcgaatttctatccgtcatggggcttgccgacgaattcaccgtggaaatggcagaatttgtcacgggaaacaaaaacgcgaaaaaactcctcacggcgctgacagagcagaacgccttcgtcaagcgcctgccggacagcgggacctaccgcttccaccacatgatgaaagagtgcgccgagcgcacgttcttgtcgctcgaccccgccgtgcaggcggtctaccgcgaccgctgcggtgcatggtacgaggcgcgacagctctacctccacgcgctcgcgtcctaccgcgcgagcgggaactgcgat

SEQ ID NO: 2862 - DNA, 438 bp, Unknown
  Description of Unknown: Ruminococcaceae sequence
atggagcagactgagatcgtcaatcaggcggaggcgctggacgaaaagaacgccttcgccgtctacaaccatatcgaatcagaatttgttgagccggaccacgctatttttcgcctgaacatccgccccgaaagcaagaatccctatggcgtagtgcacggcagcgccatctacacgatggccgacaacgcgacaggctatgccgcccactcagacggccgatcctacgtgacgcagaccagctcgatgcactttcttcgcaaccagacgcacggcatcgtgcgcgcggacgcgagggtgcgtcaccgcggacacgcgacctgtcttgtagacgtggatatcctcggtgagggcgggaagctccttgccacgggtgagtttacatatttctgcgttgatcccgcgctcatggcgaaaaaggccgaagaacagcactga

SEQ ID NO: 2863 - DNA, 720 bp, Unknown
  Description of Unknown: Ruminococcaceae sequence
gtgacgatcgtgcgaaagaaatggctgatcatgatccttttggtgctggtgctggcgatcatgctggtcctgcgcctcaagggcacaaaggataaagaagacgcttcgacaaacaatgctgacggccaaacggaacagacggatgtgaaaagcgcagccgatacgaacaatgtcacggatgagacgctcggctcgctcgcagcaaatgaaagcggtgtagatattacggtgacggcgaaggacggcacggccaagacctatacctttaccgatgttgcgcttgacgcatggtatgcgcaggcggtcgactatgtcgtttccaccggcgtgatgagcggtgatgaggagcagagcctcttccggccagagtacggcgtggaacgctcacagttcgctgtcatcatgtaccgctttgcaggcggtacgccgacggcggaggaggcgagcttcagcgacctcacgggggacgagtggtattatgaatatgtcaaatggatggtcggcgagggactgatgggcggcaatggcggcgcgtttgatccaaacggtttcctttcctgtgagcaggcactcattgtgctctaccgtcttgcgggtgaaccggccatcaccggcacgcttgagggatatccctatgcacccaaggtttccgagagcggtaaggatgctgtgacttgggcgtggaacagcggactcatcacggaaaaggaatgtgtctgg

SEQ ID NO: 2864 - DNA, 414 bp, Unknown
  Description of Unknown: Ruminococcaceae sequence
atgaacattgattccacaaagctgaccgtgttttttgagccgccgttctgggtcggcgtgttcgagcgcatcgagaggcagcggctctcggtatgcaagatcaccttcggtgcagaaccgaaagactacgaggtttgggaatatctgctcaaaaatcacagccgactgcgcttcagtccgtctgttgccgcaccgcaaaagaaagccgccgccaatcccaagcgctcgcagcgtcagcttcgaaaagagaccgccgccgggatcggcacaagatcgcagcaggcgctgcaaatgcagcgtgaagcaaacaagctggcgcggaccgcgcagaaccgtgcgcagcgcgacgaggaaaagcagcgccgctttgcgcaaaagcaacagaaacgaaaagaaaagcatcggggcagataa

SEQ ID NO: 2865 - DNA, 591 bp, Unknown
  Description of Unknown: Ruminococcaceae sequence
cagaacggcagcgtccgcatcggcggcgtggacgtgaaggacatgaaaaagagcgagctgatggataccgtgtccttcgttttccagaacagccgcctcttgaaaatgagtattctcgataatgtgcgcatgggccgccccgacgcggcggaggatgaggtcctcacggcgctgaaggccgcgcagtgcatggacatcatcgaaaagctcccgcagggcgtgtacacggtcatcggcacgcagggcgtttacctctccggcggcgaagcgcagcgcattgccatcgcccgtgcgatgctcaaaaacgcgccggtcctcatcctcgatgaggcaacggcctttgctgaccccgacaatgagaccagggtgcaggccgcgatggcggagctcgccaggggtaagaccgtcatcatgatcgcgcaccgcctttccaccgtcgtgaacgctgaccgtatctatgtcctcaaggacggcaggatcgccgagagcggtatgttcggcgagctgtcggccgttcccgagagcctgttcggcacgatgtggcacgactatcagcagtcggtgcagtggaaagtggcaaaggaggcgtaa

SEQ ID NO: 2866 - DNA, 657 bp, Unknown
  Description of Unknown: Ruminococcaceae sequence
ttggaaacgaatatcggcggagcatccgctttggaaaaaggagatatcactatgacgatcgaagtaaatgcgatgggcgaagcctgccccatccctgttgtgaagacgcagaaggccatgaaggagcttggcggcgcgggtgtgatcgagacgctggtcgacaacgagacggcggtgcagaacctcggcaagctggccgcgagcaagggctgtgcgtccaagaccgaaaagctcggcgagaatcagtaccgcgtgaccatcaccgttggcgagaacaccaacgtggaggaagagagcagcgaatgctatacctgcggcaagccgaaggtcgtggcagtgctgtcctccgacaagatgggcagcggcaacgacgagctcggcggcgcgctgatgaaggccttcgtctacgccctgagccagcaggagatcctgcccgacaccatcctctgctacaacggtggcgtgaagctgacgtgcgagggctcggagtctctcgaggaccttaagggcatggcggagcgcggcgtggatatccttagctgcggcacgtgcctgaacttctacgatctgaaggaaaagctggcggtcggcgaagtgacgaatatgtatgtcatcgtcgagaagatgagcggtgcggaccgtgtggtgcgcccgtaa

SEQ ID NO: 2867 - DNA, 1086 bp, Unknown
  Description of Unknown: Ruminococcaceae sequence
gagtacgaggtcggcgcgcgctacaacatcgccgagacctgcgtggactctgtttcgctcgacgagctttttgagctgacgggcgaggataaagatacatttttgaaggatatctgtgcccgccgcctgacttacggcgatatctggggcagcgatgagctgcgcgcgggcgtgacgaagctctatcacacggtgaagccggaggaggtcgtgctgatgcacggcgcggccagcgcgaaccaccatgtcttctgctcgctcatctccgcgggcgaccgtgtcgtgagcatcatgccgacctatcagcagctctattccatccccgagtccatcggtgcggacgttgccatcatgcacctgaagcaggagaatgatcacctgcccgacttagatgagctcaaggccctagtcacgccggaaacaaagatgatctgcatcaacaaccccaataaccccaccggtgcgctgatgagcagagcacttctcgagagcatcatcgacattgcgcgcggcgtgggcgcttatgtcctgtgcgacgaggtctaccgtcatctgacgcaggaggacggctggtgcgagtcggtcgccgacctctatgaaaagggcatctccgtcagcagcatgtccaaggtcttttcgctcgcgggattgcgcatgggctggatcgccacgcacgacaaggacgcgctcactgctttctattcccaccgcgattacgatctcattagctgcggtatgttcgacgatgcggtcgcgaccgtcgccctgcgccacagcgacgtgatgatccgccgcaatcaggccatcgtgcgcgagaatcttgccatcctcgatgattgggtcaaggcccatccccacttcttctataccaagcccaaagccggaacgaccgcgctcgtctactacgactacgacctcccctcctacgacttctgcaagcagatgtaccacgccaccggcgcgttcgtcacgccgggcgactgctttgagcagccgcgcagtatgcgtatcggctacgcctgcgacgtacagacgctcaaggacggcctcgatgcgctggcggcgtttgccgaaacgctcgcatga

SEQ ID NO: 2868 - DNA, 936 bp, Unknown
  Description of Unknown: Ruminococcaceae sequence
cgcttcctgcggcagaagctcgtatccttccttgcgaccaagggcgtgaaggcctcgtcgggcgagatacaggtgttggccgagacgaaccaggcactcgactttatcgtgacgcttttgataaaccccggcgacagcgtcgtgatggaggagcctgtgcacccggatatgtaccgcgtgatggaacttgcgggggcgaagatcctcgccgtgccggtcgatgagaacggcatggactgcgcggtgctcgaaaatctgctcacacatacaaagccgcgccttatcttcgtcaattcgagctatcacgaccccacagggcatatcctgtcgctcgagcggcgcaaaaagctcgtcgagctctctaaccgctaccgcatccccgtcgttgaggaggatgcggcgagcgagctcgcctacgagggcgaaaagctcccgcccatcaaggccttcgacacgatgggcaacgtcatttacatctattccttctcgctcacgttcgtgccgggactgagccttgccttcgtcacgggcaaccgcgacttcatccgcgcgctgagctacctcgtctccgtgaggctgatggcctcggactggctgacgcaaaagctcctcggcatgtatctggacgacggcagctactacgcctcgctcacagccttccgcgaaaattaccgccgcaagcgcgaccttgtgtgccgcaagctcgacgagctcgcgccgctcggcgtacagtacgataagccgcagggcggcgtttacatctggtgcaggctgcccgacggggtggacagcaagcacttcatcagccgggcctacaatatgggcgtcacgctcatccccggccacgtcttttacccctataaaaacggcggacgcgaccacatccgcatcaattattcctacgaatcggaggagcgtctggtgcagggaatggac

SEQ ID NO: 2869 - DNA, 711 bp, Unknown
  Description of Unknown: Ruminococcaceae sequence
gtgaaaaaacgaaaaggagagggcgagcagatgaaaagactctttcaaaaagagaggagcacaggcggcgaggcggcggtgcagctcagaacgggcggacgaagcgcgttcggcgggcttgatggctatgtgccgctgctggatggggacacggaggtctaccggctggtgcgcgaggcggtgccggtggtggacgcggctgtcggaaagatcatccgtctgacgaacggtgtgaaggtctgctgcgaggacgaaagggcggagctggagctggagcagtttttgcgcaatgtgccggtgggaagaggacagaggggcatcaacgcgtttttaagctgctacctcgattcgctgctcacctgcgggcgcgcggtgggcgagatcgtgccggatgcggcgggacgcgacatagcggcggtgttgtgcggggacgtttcgcaggtggaggtgcacgagggagacagtccgctggacttttatctcagcgggcgggacgcgtgcgggcgcagcgtgccgctggaatttcaggacctgctgctctttacgccgtataaccccgaggcggggcatccctacggcgtatcgatgctgcgctcgatgccgtatctgacggggctgctcatcaagatatacgacgcgatggggaaaaactgggagcgctgcggcaatgtgcgctttgcggtgacctataggccgcagggcgaggagctg

SEQ ID NO: 2870 - DNA, 441 bp, Unknown
  Description of Unknown: Ruminococcaceae sequence
atggaactcaagataaaacatttttccgagctgagcgcgcaagagctgtttgcgatctacaagctgcgtgtgtcggtctttgtggtggagcaaaactgcccctatcaggaggtggacgatgcggatgagcacgcctaccatgtctggtttgaggatgaggacgggatcgaagcgtatctgcgcgtggtagagccgggcgtggtatttcccgagtgtgccatcgggcgcgtgatcgcggtcaagcgccgctgcgggctggggacgaagatcgtttccgcaggactgcgcgccgcgcaggaaagatacggcgcagaagcggtgcgcatcgaggcgcagacctatgcgcggaagctctatgaaggtctgggttttgtgcagacgtcggaggagtttttggaggacggtatcccgcacatcgggatgctgtggcaaaaaaagtga

SEQ ID NO: 2871 - DNA, 756 bp, Unknown
  Description of Unknown: Ruminococcaceae sequence
ggcgatttgcagggaaactcgctgcaggagagcatttactggaacattctcagtcaaatcgatcaaaaaaatctcagcggggagtattttgatgactacgattcctatttgcaggacttcccctcgcttgcgacgctgaactttacggaagacggtctgacggtcacgttcgaccagtacgttatcgcgccgtatgcggcggggccgcaggtgttcgaggtgccgtatgatgctttctacagcgcgctcagcgagcacgcaagggaaatattagacgtgtcgcaggagcggctcgtgctgtcggatctcgacacggcggcaacgctgtggtcgtggctctttatgacaacgccgccgaccggtgatacgccggacaaggcggagatcaacgggtatacctactacagtgcggacatccccggcgtttcgacactggaggatatgcaggagctgatgtaccgttatttcgatagagcgctggccgacgagtggcttgaagagtccgagcgctacgctgaggtggatggcaggctctatgtgctcgatgccgaccgcggcagcaacgactccatcattgatgatgtgcgcagcgtgacattggacggtgagggcggtattgtgacgcagaccgttacctacggcgaatggaacgaggcgtcgcagagccaggtcccgaacggggaagagacctttgaatatccctttatccttatcgacggccacgcggtattctccgcattcccgtatccgtactga

SEQ ID NO: 2872 - DNA, 777 bp, Unknown
  Description of Unknown: Ruminococcaceae sequence
atggatgaagctaaaattctcatcgccgatgactctaaaatgaatcagcagatattgtccgagatactcggcaagcgctacgattacctgtatgccgacgacggcgtgcaagcgctcgacctgctgcacgagcatttcgatatcggccttttgctgctcgacatcaatatgccgcacctcgacggcttcggcgtgctcgaggtcatgcgccagcgcaactggctgcaggatatccccgtcatcatcatctcgtccgaggacggcgcggacctcatccagaaggcatacgatctcggcgtgaccgactatatcggcaggcccttcaacctcgtggtcgtgcagcgccgcgtgagcaacgcgctcgcgctctatgcgcgccagaaggacctcgtctgcctcgctgaggagcaggtctacgagcgcgagaagacgaataccaccatcatcaatatcctgagccgcgtcgtcgagtcgaagaacttcgaatccggcatgcatatcctgcatgtgcgcaccatcacagacctgttgctgcgccagatcgtcaatatctcggaccgctatcccctctcgcaggcggatatctcgatgatcagcaccgtttccgcgctgcacgacatcggcaagatcaatattcccgccgagatcctcaacaagcccggcaagctcacgcgtgagcaatttgagatcatgaaggcccacacgaccgagggcgacaagctgctcgacgatatgatcctgccgcaggatgacccgctcatgcgcaccgcgcacgaa

SEQ ID NO: 2873 - DNA, 585 bp, Unknown
  Description of Unknown: Ruminococcaceae sequence
ctcaagccctacggtgtgcgccgcggcgacagcgtcatcaccgtgctcgacgaggaccgctgcatggtggatgtggccgcgcggttcatggaatatacgcagacggagttctgcggcaaatgcgtcccctgccgcgagggcacgaagcgcatgaatgagctcctctgggggctgaaggactaccgcatcgaccgcaaggagttcacactgctcaccgacctcggtgagatggtatcggtcacggcgttctgcaacctcggcaaaaactcgttccatacgctggaaacagcgatcaaatacttccccgaggaattcgaggatcatctcaagggcgaatgcgcgctctgcgagcgcgaccgcgagcccatcgagcccggcggactgccctataacaagatccgcctgatcgtcgacccaacgatctgccgcggatgcagcaagtgcgcgcgcaactgccacgccgacgccatcacgggcgtcatcaaatcccccttctccatcgatccggagaagtgcgtgaaatgctatacctgcatcgaggcctgtcccttcgatgccatccgggaggtggagatcgatggctaa

SEQ ID NO: 2874 - DNA, 897 bp, Unknown
  Description of Unknown: Ruminococcaceae sequence
atggaagtccgcaatctggtcaccttcttgaaggttacggaactcaaaagtttttcccgcgccgctgaagcgctggactattctcagtctgccgtgacggtgcagatacagcagctcgagcgggagctcggcgtgcagttgttcgaccgcatcggtaaaacggtctccatcacgcaatacggcaaggactttgtctcctacgcgcgtgacgtggtcagtgccatcgcacgggcgagcgcttttgcctcgtccgactccgagctcagcggcacggtgcgtgtcggcacgctcaactccctgctcacggcatcgttttccgatatcgtaccgctcttccacgagcgcttcccgcacgtgcagatcaacctgcacgcgggcaacatcgcctccatcacggagatgctcgtaaaaaacgagctcgacatcatctatacgctcgatgcgcagatcttcgacactcaattcgtcaaggtctttgaagcgcaggaggacgtagtcgtcgtgacgaacgcggaaaatccgcttgccgaacgcagcgacgtccaccttgcagaccttgtctcgcatccatttatcctgatgaatcacggcaatccctaccgcgaccagttcgaccgtgagcttgcccgtcaggacctgagtgtggagccgtttttggagctcgagagcgacacgctggcgctcaggctgatccgcgagaacccggagtacctctccatcctgccgctctacacggcggagatgagcatccacaaggacaaccttgccatcatccccgtggcggactgccagatgcgtcagtggcgccaggtgctctaccacagaaacaaggtcatcacaccgcagatccaggggatgctggacgtcattctggaagtggcgaaaaagccgttttga

SEQ ID NO: 2875 - DNA, 735 bp, Unknown
  Description of Unknown: Ruminococcaceae sequence
ccggactggcagagctatatccgcggtggaagcttccgcccgaacgtgccgacggtgcagatggtcaaccatcttgaatttgaagagggcatcatccgcatgagcacgggcgagctttcgcccgacctgatgcagatggctatcgccaagcaggtgctggcgaacctctcggtcggcgaccgcgacctctttatgaactatccggacccgctgggccttcccagcctgcgcgaggcgctgcgctgccaactgcaaaaggtcggcatcgatgtgccgatctcctgtatcctgatcgtttcaggcgcgttgcaagccttgcagctcatctccacaggcatcgtgcagccgggggcgaaggtctatgtggaagcaccttcatatctgagctcgctgaacattttccagtctgtcggcgcgcgcctttgcagtatgccgatggatgaagaggggctgctgccgtggatgtcgcgcgagacgcaggatgacacgaatcacgccctgctctacaccatcccgacatttcagaacccaacaggcatcgtcatgccgacgccgcgccgcgaaaagctcctgaaatactgcaacgagatgcacatccccatcatcgaggacgatgtcttccgcgacctgtggctcgattcgcccccgcctccgcccatcaaatcgctcgacggacacggcaatgtcgtgtatatcagctcgctgtcgaagtgctttgcgccgggcctgcgcctc

SEQ ID NO: 2876 - DNA, 2181 bp, Blautia sp.
atgggaatcatctactgcgagaaagacagaacgtttaccctacagacaaaagaaactacatatcagatgcaggtggatcagtacggatttcttcttcatctctattatggtaaaaaggcagaaggctgcatggattatcttctgacctactatgacagaggattttccggaaatccctatgatgcgggaacagacagaacctattccatggactctcttccacaggagctttcctgctacggaaacggagatttccgcagtgcatcactgatgctggaaaacggtgacggaagcatgagctgtgatatgcgttacaagaattatactatccgtgacggtaaatacagccttccggggcttccggcggtttatgcagataatgatgaggcacagactctggagatcgtactggaggatccggctaccggcgtggaggccatgcttctttacggtgtacttccggaactggatatcattacaagaagcgtctatatccgcaatcagagcagtgagaagatctatgtgaacaaggtgatgtccgcagaactggattttctttacggagattatgacctgcttactttttacggaagacatgccatggagcggaatctgcagagagtaccggtggctcatggaagtcagatgatcggcagtgtccgtggcacatccagccatcagtataatccgatgatgatcctggcagagaaggacacaacagaggatcatggaggctgctatgctatgtcctttgtatacagcggaaatttccagggtgaggttcttaaagatcagtacaatcagacaagaatgctccttggtgtacaggaggagtgcttccggtatccgctggaagccggggagaccttctatgcacctgaggtgatcttaagctacacagatcagggaatgaactgtctttcccagaatctgcacagctgcatccgtcatcatatctgccgtggtaaatataagacagaggtccgtccggtgctggtaaacagctgggaggcagcatattttgattttacaggggagactttatataatctggcaaaagaggcaaggagccttggtatcgatatgctggttctggatgacggctggtttggaaaacgtgacgatgacaacagtggtcttggggactggtatgtcaatgagaagaagcttggagagactctcggcggactggtaaaaagagtcaatgacctcggagtgaaattcggtatctggatcgagccggagatgatctctgaggacagtgatctttaccgtgagcatccggactgggcacttacgattccaggaagaaaaccagtgagatccagaaatcagctggtacttgatttttccagaaaagaagttgtagacggaatctttggacagatcagtgcggtattggataatgccaatattgagtacgttaaatgggacatgaatcgaagcctgatggatgtattttccgtaatgaccaaggatcagggacgtgtaatgtatgattatgtcctgggattgtacgattttctggatcgtatggtgaaccgttatccggatcttctgatcgagggctgcagcggcggcggcggaagatttgacgcaggtatgctgtattacacaccgcagatctggtgcagcgacaactccgatgctattgacaggcttcggatccagtatggcacttccttcggatatccggtatcggccatgggagcacatgtatctgcagtgccgaaccatcagacaggaaggatcaccccgttacataccagaggtgtggttgctatgtccggaaccttcggctacgagctggatcttctgaagctgactgaggaagaaaaagatgaggtccgcagccagatcggggaattccgtaaatatgcgccactgatccagaacggacggtactatcgcctgacagatccgtttaagagtgaggtctgtgcatgggagatcgttggaaattctcaggaagaagttctgctcaatgttgtcatggaggagatccatggaaatatgactgtgaattatgtgcagcttcgcggccttgatgagagtgcactttataaggaacagactaccggcaggatctattccggagctgctctgatgcatggtggaatgccgcttcctgcagagtttggggagtacagagcttatcagtatcattttgtgagagaataa

SEQ ID NO: 2877 - DNA, 1905 bp, Blautia sp.
aggaggtctataatgagtgaattcaaattaactacagtggaggaatttgaagccgctacagcccgtcttctcgagacaggtgcaaaggtaggagcagatgcatggcagatccgtgcaaagaaccagactccgcactgtaaattcggtgagcagggtatctgctgccgtatctgtgcaatgggaccgtgtcgtattacaccgaaggctccaagaggaatctgcggatgtgatgctcatggtatcgtaggaagaaacttccttaaatttacagccggtggtgcagctactcactccgatcatggtcgtgagatctgccatacactgtactgtgcaaaagagggcggaaattatcaggtaaaagatcctgagaaactgcttcgcatcgctaaagagtggggcgtggagacagaaggcaaggatatctatgatctggctcatgagatggctgagatcggtcttatggaatatggtaaaccgttcggatatcagagattccttgacagaatgcctgcaggacagaaagaaaaactgatcgagaacgaaatcgcaccacgtgctatcgaccgtgaggttgcaagctccctgcatatgtctcatatgggatgttcatctcttccggaggcacttgtaaaacagtctattcgctgcggtatggctgatggatggggcggttccatgatgggaacagagttctctgatgtattattcggaactccgaagccacttgatacagaggctaaccttggagtaatggttgaagagaacgtaaacattgttgtacacggacatgatccgagtctttctgagatgatctgtgagtatgcagacagcaaagaaatgatcgattatgcaaaatctgtaggagcaaaaggaatcaccgtttccggtgtgtgctgtacttctaacgaggtagctatgcgtcgtggtgttccgatggctggtaacttcctgcagcaggagaacgtagtactgacaggtgcttgcgaggcgatcgtagttgatgttcagtgtatcttccctgcattaggacctctgagcaaatgtttccatactaaatttgttacaacttctccgatcgctcagatgccggattctgaatttatcagattcaacgctgagacagcaggagaaaatgcaaaagcaatcgttaagatggctatcgataacttcaagaacagaaaacctgagcttgtacatatcccgcagctgaaacagaaagctactgttggttactcagtagaagcaatcgtcaaagttcttgatggtgttacaaactctcaggttgacgtaacaggaacaaccaaaccattacttgagtgcatcacttccggtgttatccgtggtgctgttgctatggttggatgtaacaatcctaagatccgtcctgactatgcacatatcgaactgatgaagaagtgtatcgcaaatgatatcattatcatcgcttccggatgttccgcacaggcagctgctaaagctggtctgatggacaaatccgcaagagatctctgcggtgcaggtctgaaacgtgtctgtgagctggctgatatcccaccagtacttcatatgggatcctgcgtagatatctcccgtatgatgatcctggctgctgaacttgcaaaagatgcaggacttcagatcaatcagcttcctgtagtaggatgtgctcctgagtggatgtctgaaaaagctgtatccatcggtaactacgtagttggtactggtattgatacattccttggcgttgatccatatgtttccggttcttcagaaatgtgcgagcttcttacagagggaacaagaaaatggacaggtgctgcttacacagtagagacagacatcgagaaattagttgatcttatgatcgagagaattgaagagaagagaacagcattaggaatctaa

SEQ ID NO: 2878 - DNA, 1407 bp, Blautia sp.
ttcagaaaaaagaaaccagagaataagtattggagaacccggataaccatatcagttaaatgggtgatatccgacttatcaaataaaaggaaaaggaaggagcattacaagatgcgcaacagaagtaaatggatcctctgtatgggacttgcctttaccatggcagcttccgttacattgagcggatgcggcacaggtaaaaaggacagcggaaagacagagatcgaacttgtgcagtataaaccggaagcggttaaggcatttgaaaaactggaagaaaaattcaatgccactcatgatgatatccatcttaccatcgaatcaccaaacgatgctatgactgtattgaagacaagatttatccgtgaggataatccggatatcattggaatcggaggcgatgttaacttttccaattttattgattctgatatgctgatggatatttccgattatcagggactggattcgatcaaagatgcatataaagaaattgataaagcgctggaattcgttccggaagacggagtctatgcggttccttacgtggccaatgctgccggaatcctttacaatcgtgagcttttcaaggagcatggctggcagatcccgactacatgggatgaatttatgagcctttgccaggaaattcaggatgcaggtatccagccgctttatttcggatttaaagatacctggacctgtcttgcaccgtggaattctattgcggtagatcttgcaccagccgatgtatgccgccaggtaaaccagggaaacactacttttgcaaaagagtataaggaagtagcagaccgtatgctggagcttatccagtatggaccggatgatccctttgcctatgattacaatggagcctgcaccgcttttgcaaaaggggaggctgccatgtatcccatcggaagctatgcgatcccgcagatccagagtgtaaatccggatatggatattgattcttttgtaacaccggcaagcaatgatccgtcagaaaacaaactgaattccggagttgaccttcagttctgtgtgatggatgactgtgagaataaggaagctgcatatgaagtgctggatttccttcttgaggatgagaatatacagacatatctggatgaccagaaggcagttccctgtaaagagggtgatttcacacttccctctactctggatggtatgaaggaatacatagaagagggaaggatggccgactaccaggatcattattatcctacagagatggctgtggatgcacagatccagaccttcctgatgaaaaaggataaagatgcattcctgaaaaaatttgatacagactggacaagatataaccgtgacattatccgtaaagtacaggactatgaggagaagaacggggaaggagagaactga

SEQ ID NO: 2879 - DNA, 1653 bp, Blautia sp.
atgaagaaaaaatttttgaccacagaactgctgcgtgatataattccagtaaacaacagcagaaggagaatgagcttgaaaatggaggatacagtaaaaaacagaacctgtccgaaacggccatttgcatggtatgtggaaaaaccgtctgcaaaagattacttgctgacggtttttatatttgcagtatgcactttgattggcctgctgtttcagaagctggattttacagatacgaatattgtaacgatatacattctgggtgtgttgatcacttccatcgtgacagatggttatctttgcagtgtagcaggctcctttttaagtgtattcttattttgttttttcctgacggagccaaggatgtcttttgagacatatgcggtgggatatccggtgacatttttcataatgcttatttcgtccgtacttacaggaacccttgcggcaaagctgaaaatgcatgcaaagctgtcttcacagattgcctttcgcacacaggttctgtttgatacggatcgtctgctgcaaaaggcaaaaagtgagacagaaatcctcggagttacctgtacacagctgatacgcctgttaaatcgcagcatcacggcatatgttgtggaaaatggaactttatcagaaggaaagcttttttccggggaaaaagagagcacagaggattttctgacacaggaagaacaacaggcggccagatggacttatgaaaacagacagcgtgccggcgcatccacacagtatttctcacaggcaaaatgcttatatctggcaattcgaagcgggaataatgtttatggcgtaatcgggatccctctgcagaaagaaacactggactcttatgaatacagcatcctgctgtctgtaataaatgaatgtgcacttgcaatggagaatgtacaaaatgccatagaaaaagaaaaaaatgcggttttagcaaaaaatgagcagctgcgtggcgatcttcttcgggcgatctcccatgacctgcgtactccgctttgttctatttccggaaatgcagatatgcttctcagtaacagtgaccgtctggatgaagctacaaggtatcagatctacacggacattcatgaggattcagagtggctgatcggagttgtggaaaatctgctttccattaccaggctcaatgatggaagattgaagtttaaatttacggatcagcttttggatgaggtaatagcagagtcactccggcatgtcagccggaagcatgatgcgtataagatcgtggcggactgtgaagaacttgttcttacacgtatggacgtgcatcttattatacaggttctggtaaatttgatcgataatgcgataaaatatacgccgtcaggctctgtcatcagcattcgggggttcaaaaaagccgggaaagcacaggtaagcgtggaagataacggccccgggatcccggatgaaatgaagccacatatttttgagatgttttatacagggaaaacaaccgttgcagacagccaacggagtctggggcttggcctggcactttgccgctctatcatagaagctcacgatggaacactggttctttcggatcatgctccgcatggatgtaattttacttttactttaccattaagcgaggtgacattaaatgaataa

SEQ ID NO: 2880 - DNA, 1524 bp, Blautia sp.
atgagtgaaaaacttgaaaaagcacgtctttatgaaatagaggaagcaaaaaatatcccgcaggaagagaaaccggcctttcatgtatctgcaccggttggctggatcaatgatcccaatggattttctgtttttaaaggaaaggtacatcttttttaccagtatcatccttacagccgtgactggggccctatgcactggggccacagtgtgacggaggatatgatcagatgggagcagcttcctgcagcgcttgcaccggatcaggaatatgatcgagagggatgcttttccggaagtgctattgaagcggatggaaaacaggctttgatctacacaggagttacaacagaaaagctgcctgatggaaaagaagaagtccggcagaatcagtgcattgcctggggtgacggaaaagattatgtaaaggcagagaaaaatccggtagtcaccggggatatgcttccggagaaatgcagcagagttgatttccgtgatccgaaggtatgggaagataacggaacataccatatgctcgtaggatgccgcagcgaagaaattcctggacaggtagttctgttttccagtaaagatctgaaagaatggaaatttgaaacaattcttgcggagaactccacaggagaaatcggtgttatgtgggaatgccccgatttctttccgctcggggataaacatgtgctgatctgttctccgcagcatatgcgtgcaaaagggtatgagtttcataatggacataattccctgtattttacgggagattatgacagcgaaaaacatacatttgaaaaagacgcaccggtaagtctggactacggacttgatttttatgcgccgcagacaacccttcttccagatggaagaagagtgatgatcgcctggatgaaatcctgggatagctgtgtgatcaaggaaaagcagagatggcagggaatgatgactcttccgagagagctggaatatcgtgacggaaagatctggcagaagccggtccgagaaattgagaattatcggaaaaaccgttgctgttatgagaatgtaaaagtgggtgagagcttaagccttgaaggcgtccgtggccgaatgatcgatctgactgtggaactgcagaacgcagatggcatcatggatggaagcaggaactccggaaatccaaatcaggaagcattggatgtgtacaatgagttccggatcgagcttgcacgcaatgaagaatatacaacggtctttacctatgatcgaaaaagacagatactggaaatcgacagaacctggagcgggatgcagcgtgatgttatatgtacaagaaagctccagatcacagatgacagacaaaatctgaagctgcgttttatcctggatcgaagctccatagagctttttatcaatgatggaagcaaaactgcgactaccgtgatcccaacaccagtggaagcagatgagatcctgtttcacagtgacggaaatgctgtgatccaggttgagaaatatgatattgtgttgtag

SEQ ID NO: 2881 - DNA, 2001 bp, Blautia sp.
ttgaagactggaccattacaaaataaggaaaagatcatgcaggaaaccgttttggaattaaaaaactattcggtaagctttgacacaccggacggcaaggtacaggccgtccggaatgttgatctcacggtaaaaaaaggagagatactttgtatcgtaggtgagtccggatgtggaaaaaccgttatgtgccgtagcgtgatgaagcttctgccaccgaatgcacatgtaaaaagcggagagatcagtctctgcggagagaatatcacagcctataaaagaaaaaaaatggaaaagctgtgcggaagtaaggtaagcatggtgttccaggatcctatgctgacgctgaatccgacgatccctgttggcaaacagatcgcagaggctattatcaaaaatcagaaagtatccagggatgaggcgaaaaaaagagctgtggaaatgctgaagctggtagggattccggatgcagaacagcgatatggactgcaacctcattttttttccggaggaatgcgtcagcgttgtgtgctggctattgcactggcctgtgatccggaaatattatttgccgatgaggcgactacagcactggatgcaaccgtggaagcaaagattctggatctgcttcttgagctgagagaaaaaacagggatcagtattgtgttcatatctcatgatctgggagctgttgcaaggatcgcagacagagttgcagttatgtatgcaggaaagatcattgagatcgggacagcggaagaggtttattatgatccccggcatccttatacctggggacttctgtcttcactgcctgtatttgcaggtgaaaaaggggagctgaatccgatccccggaatgccgccctctcttttgaatcctccgccgggagatgcatttgccgttcgaaatccccaggcgctggcaatcgattatgaacagactccgccgatgtttaaagtcagtgatacgcattatgcagccacatggcttctggatgaaagagctccgaaaatagaaaagccttccattttgaaggacagattacaggaaaacagcggccgtaaacagaaaccggataaaaaggaagcgtcatttttacagaaaacagaacagaaacaggcgcctgtactgatcgaagccagaaatctgaaacagcatttccgtatccgttccgattatacgatccatgcagtggatgatgtttccttcagtatccgggaaggtgagatcatggcactggtgggagagaccggctgcggaaaatccacgacagccagaacgcttgcaggaatctaccggcccacaggcggggagatcttttatcagggagaaagagtgccggataaaaaggatcctttcggaatgcggaagaaaatgcagactgagatccagatgatctttcaggattcgggcgctgcactgaatccccgaatgagcatacggcagatcatgctggagcctgtaaagatcagccgcaggatccgtgacagagaaatgctggagaacaggcttcgggaaatcctgaaggagacaggactggatgaaagcattctgtcgaaaaagccgggagagctttccggcggacagagacagagagttgccataggaagaagccttctcatggaaccacgtcttatcattgcagatgaaccgatcgcatcgttggacatttctatccaggcacagatcgtcatgctttttaaaaagcttcagcaggaaaaaagattttcttttctttttattgcccatgatctgtcaatggtacgttttttaagtgatacaacaggtgtgatgaaaaacggaaagctggtagaaatggcacctacaaaagagctttttgaaaatccgcaacatccttatacacagtccctgctttctgcgatccatatcccggatccgctggaagagagaaaacggaggttgatcgagtatgaagagccacagtctcttggagagggctggaaagaattatccgcatgtcactgtgtgagaatataa

SEQ ID NO: 2882 - DNA, 2298 bp, Blautia sp.
atgtatataactgaggatttggttattgaggttgtcagcggtatttttatccgcagtaaacaaaaaaaggagaaaattatgccgatcaaatttcacgagggatcaaagacattccacatttataacaaacatttaagctacatcacctgtatcatggaaaatggccagatggagaatctgtactatggaaaagctatccgcgataaagaggatttcagttatcttcacgaggagatcatgcgttccctgatggctgtatgcgttccggaaccgggacttctttccatgcagtataccaaacaggagtatcctgtttacggaaccggtgatttcagaaatcctgcccttactgttcgtcaggagaacggaagcgagatcgtagatttcaaatatgtttctcatgagatttacggcggcaagaagaagcttgccggtcttccggcaacctacacagagaacgaggaagaggcaacatctctggacattacacttcatgattctgtgatggacacagaccttgttcttacatattccgtatatgaggattacccggtggtcaccagaagtgcacgccttgttcagaaagggaatcagaaaatccgtcttgagaacgtgatgagtgcagcagtggagttcccggatatggattatgagatgatccatctttccggtgcatgggcacgtgagcgctatgtaaaaacacgcaaacttgagatgggtatacaggctgtacagagtcttgcaggaaccggctccagctctgagcagaatccgtttatcgcgctgaagcgtcctcatacaacagaagatacaggcgaggttttcggcttcagctttgtgtacagcggcaacttccttgcacaggtcgaggtttccacctacgagatgacacgagttatgatgggaatcaatccacagggattttcctgggagctttccagagatgaggaattccagactccggaggttgttatggtatacagcgataagggcttaaacggaatgagccaggcttaccacagactgtaccgtgaccgcctgatgcgcggaaaatggagaaatcatgcacgcccgatccttcttaataactgggaggcaacctattttgattttgatgaggaaaaaatcctcaatattgcaaaaaaagccaaagaggttggggtagagcttttcgttctggatgacggatggttcggaaccagaaacgatgattaccagggccttggcgactggttcgtaaataagaataagcttccaaacggaatttccggactttcccgcaagatcgaggagatgggcctgaaatttggcctctgggtagagcttgagatggtaaacaagaacagcgactgctacagagcacatccggactggctcatcggagcaccggaccgttttgagtcccactcaagacatcagcacgttcttgatttttccagatctgaggttgtggattttatttatgattccatctccaaggttatcgaggaatcttccatttcctacattaaatgggatatgaaccgctacatgtccgagcctttcagccgcggcgcatctgcagcagatcagggcaagactatgcataaatatatccttggtgtatatgagctgtatacaagactgacagagagattccctgacattctctttgaatcctgcgcaagcggcggagcaagatttgatccaggaatgctgtactttgcaccgcagacatggaccagtgatgataccgatgcagcagagagagaaaaaatccagtacggtacctcctttgtttatccgatcgtcagcatgggatctcatgtatcagcagtaccgaatcatcagctgcaccgtaccacaccgctttccacaagagcaaatgtggcatatttcggaacctttggctatgagctggatctgaaccttttaagtgccaaagagatcgaagaggtaaaggcacaggtggaattcatgaaggaacatcgtgacctgatccaggtggagggtgatttctaccgtatcttaagcccgttcgaaggaaatgatactgcatggatggttgtttccagagacaaaaaacaggcagttgccggatactatgaaagactgaacaaggtcaatgcttcctggatgcgtttgcgcttcaagggtcttgacgaggatcagctttacaaagtaaaatgggaagataagtgcctgaaagcttacggaaatgagctgatgtatgcaggaatcccggttgatcgtgactactgcaataagacaaacggtgatttccattctgtattgtatacaattgaagcagaggactga

SEQ ID NO: 2883 - DNA, 1263 bp, Blautia sp.
gaagaagttatgaattttaaaagagtagcagcattattgttagcaggtgccatggtaatgacagcagttccggtatatgcaaaaggtgacgatgttacactttccgtatccatctgggacaccaaccaggagccgggaatcaaagaaattctcgcagacttcacagagaagacaggaatcaagacagagatctccgttgttaaatgggatgagtactggacaatgctcgaggccggtgcacagggtggttcccttccggacgtattctggatgcactccaacgagagtcagagatacatgtccaacgatatgcttcttgatctgaccgacaagatcaaagacagcgatctgatcgatccggagaactatccggaggatatctggggactgtatacatacgatgataaatattatgcagtaccgaaggatatagatacaatcgctctctggtacaacaagacattatttgacgaggcaggacttgattatccgacagctgactggacatgggatgatgttacagaggcagctaagaagcttactaaggatgatggttcccagtacggtctcgcaatgagaaatgataacaaccaggccggatactacaacctgatctatgataacggcggatacatcatcagcgatgacaagacaaaatccggctgggatgatgagaagacgatcgcagctatgcagacactggaaggatggatcaaggatggcgtgatcccgtctcttgagacaatgtccgagaacaacgaggacgtacttttcgaggctggcaagatcgctatgacatgccagggctcctggatgcttgcagcatttaaagagaacgagtacacagcagcgaactgtgattgtgtagagcttcctaagaacgctgagacaggcagaagagcttcctcatataacggacttggatgggcagcatctgcttccggtgagcacacagacgaagcttggcagctgatcgagtacctcggatccaaagaggctcaggagaaacaggctgagcttggtgttacaatgagtgcatacaaagatacatctgatgcatgggctaaatccgcagacttcaaccttcaggcttatctgaacatgatggatgacatggagatccgtccatactccaaatctactgtaacatgggagaacgaggacaacgagatccttaagggcgtatacacaggcgacatcacaatggaagaggcttgcaagcagatggctgatcagatgaacgagaagctggctgaggagtaa

SEQ ID NO: 2884 - DNA, 1395 bp, Blautia sp.
atggacgttttaagcatatccgcgaaacaaattgaatatcatataaggcaaaggagaggtacgattatgagaatgaaaaaagcaacagcatttggtcttgcagcattaatggcagctaccatgatcccggcagttccggctatggcaaaaggggatgacagtgaaggctctgtttattatctgaattttaaaccggagcaggcagatcagtggtcagacctggcaaagaaatacaccgatgagactggtgtaccggttaccgttgttacagctgcttccggaacttatgagtctactctgaaatcagagatggccaaggatgaggttccgacactgttccaggttaacggaccggttggacttgcatcttggaaggattattgctatgacctgaaagacagcgatgtttacaaaaatgtggagagtgacgatttcgtactgaaggatgacagcggtgcagttgacggtatcgcctatgtaattgaaacatatggaattatttacaacaaagcgcttcttaagaaatactgtgagatggatggcgctgtgatcaagtctgcagatgagatcaacaattttgagacattaaagaaggttgcagatgatatccaggctaagaaagatgaccttggagttgacggtgcatttacttccgcaggctttgattcttccagtgactggcgcttcaagacacaccttgcaaaccttccaatctattatgagtacaaagaagacggaatcacatccacagatgcgatcaaaggaacctatcttgacaacttcaagaacctgtttgacctttatatcacagattctacctgtgagccaagccttctttccagcaagactatcgatgatgcaaatgctgaatttggtcttggagaggctgtgttctatcagaatggaacctgggcttatgataacatcaaagataacgaagtagcagatgaggatatgggaatgcttccaatctacattggtgttgatggtgaagaggaccagggactttgcacaggcagtgagaactactggtgcgtaaacaaaaaagcagatgagaaggatatccaggcaactcttgatttcctcagctgggttatcacaagtgatgaaggaagagaatctataagccaggaaatgggatttacaacaccattcaagacctttgatgagaattatgagtctgcaaatccgcttgtaaaagcagccgacgaatatgtaaaagctggtaaaactccggtttcatggaactttacaaccatgccttctgaagagtggaaaaaccaggtcggcagtgcaatgcttgagtatgcacagggtaccggcgagtgggatgctgtgaaaactgcatttgttgacggatgggcaaaagagtacaaagcagcaaatgaaggctga

SEQ ID NO: 2885 - DNA, 1098 bp, Blautia sp.
tttctcttatatgatcacatctgcattccgtatcataactttctgctgttaaaaggagactatttttttatggctaaaaaacaggtaacatttgccgatattgcagaatacactggtttttccaagactacgatctccagatatttcaatcatccggattctctgaccctggaaaatcaggaaaagatcgcaaaagcccttgatgagctcggctacagaaaaaacaagcttgccagggttcttgccaatggaaaaagcgaatttgtagggatcattgtcccgaacctttatcttcattattattccgaaatgctgacacagcttcttcgaagttactccgattatcattacaaatttctggtttttgtcagtgatggcggcccggagaaagaaatgcagtatctggacgagctgatggcttataagattgaaggacttattgttctcagccatactctttcctctgaaaaactggcttcctataatattcctgtgatcgccattgaacgtgaagcagaacatatatgcagcgttacaacagacaattacatgggcagcatgcaggctacttctctgctgatacgtaatcagtgtgatgtactaatccacatcaatgtccatgtacctgagaatattccggcttatgaccgtatccgtgcctttgaggaaacatgccgggaatatcatgttccttatgaactgaaccttaatgtttccggtgattcctatcaggagctttttgaacagatgcgtgtgatctttcaggatattgacagtaaatattccggtcagaaaaaaggcatatttttatccaatgatacttacgcaaatatatttctcaatctgatcttccagaaatacaactgtctgccggatgaatatcagatcatcggattcgataattcacccattgctgcggagtccatcatcccgatcactactattggacagcagattgatgtgatcgcacagactaccatggaactgcttgtggaacagatgaacgaaatgaagaaaagaaaaccggcaccgcttcaaaaaccgatccacaaaaagatcactcctgttctgatacgacgacagacaacaggagactga

SEQ ID NO: 2886 - DNA, 1992 bp, Blautia sp.
gtgacggatccggcgaaacggatttccatggatttgaataataaaaagagaaaaggaggagttgccttggcaagccgcagattaggtcgagtggagaaaggtcagccgctgatacttggagccaacaaaatggagggcggttataattttgcagtggaggcatcggaggattctgaagtatccctgcttttatataaaaaaagaggagctgccgcaccggtggagatcgtttttccaaaggatttccatacaggacgtgtgtgggcactgaagctgtgcagtgcttctctgaaggagtttgaatataattataaaatagacggtgagatcgtgcaggatccgtatgcatacggacttcacgggagagagcatttcggagtaccttacgatccggaaaaggaggtccgctgtcgcttccttaatgagaatgtttccggctgggaaaatgaaactgcaccggcagtagaatatgaaaatatgatcctgtacaagcttcatgtccgtggttatacgaagcttgccagaaagatggtttcccataaggggacttttcttggcctgacagagatgatcccttactggaaagaacttgggatcaatgccattgaactgatgcctgcctatgaattctgtgaggttccgatcaataaaccgaaggaaggcagtgaacacatcaagacccgccgaaaagaaaatgtagtgaattactggggctatgcatccggcttttatttcagcccgaagagtgcttactgcagcaccagagaaccggagcaggaatttcggtatatgatccgggagctgcacaagaacggcattgcctgtatcatggaattctattttccagaggaaacagacagcctgatggctcttcgagctttgcagttctggagagatttttaccatgtagatggatttcatgtgctgggagagggctttaaccgggagatgcttcttcgggatggaatcctttccggagcaaaactgatcttccagggctttgattttgatcatttttacagaggaaagcttccggccagacgttgcggagcggagagcaatatgaattttctccaggatatgcgccgtttcctgaaaagcgatgaaggtatggtggaggctgcagcatggcatatccgtcataacagcgagaatcatggagtgatcaattacatggtctgccaggacggatttaccatgaatgacctggtgagctacaattataaacataacgaggccaatggcgaaggcaatcaggacggaagcagctataattattcctggaactgcggtgtggaaggccctacccgtaaggtttccgtccgccagatgagggaacgccagatcaaaaatgcctttctgatgatgctgctgagtcagggtgttcccatgatctatcacggcgatgaattcggcaattcccagagcggaaacaataatgcctactgtcaggataatgctaccggctggacagactggaaaggcctttccagaaaccagggactgagggaatttgtaaaggatgccattgcttttcgtaaggcccatcccgttcttcatatgccggtggaactgaaaggggtagattatctgaccaaggggttcccggatgtgtctcttcatggggaacgtgcctggtatctgagctatgagaataccagcaggcttcttggtatgatgtactacggagcctatgcaagggaaaaagaggatctggaggctgcagaggatgattttatttacatcggctataatttccactgggaaaaccggagccttgctctgcccaatctcccggaaggcatgtgctggaaaaaaatcgcagatacctctcttcacggaacaggattctgtctggaggaggaagaagaatataaaaaatcaatcgaaataggcccccgcgccattgtggtattgctgggcagacaggaggcggagaaagatgcgatcatggcacccgtggctgcacttcaggaccatcacgaggcataa

SEQ ID NO: 2887 - DNA, 1683 bp, Blautia sp.
atgcagtcagaaaaaaatatttggacgcaaaccgtgataaaacattccgaagtgtggataaccggtttgaaaataaggaaagatgaggaaaacaaaatgaaaaagagaacaggaatcaactatggaagaaaatatgtggcgataacactggcagcagtgaccgcagcatgtacaggagcaactgcaggcagtgcggtaaccgtagctgcggcagaagaaaacaaaactctggtatatgcaggtgagtcagaaagtacaattaatccccttctgaataaccatgatgaacttccggatcttattttttcaggactgatgaaatatgatgccaatggaaagccggtagaggatcttgcagagagctatacctttgacaaggataccaatacctatacttttaaacttcgagatggtgttaagtggcatgatggagaagatttcaatgcagaggatgttgtatacacctataaggagcttacagaggatgaaaccctgggagccagcatcaccagcaactatcaggacattacaagtattgaggcaccggatgatcagactgtgatctttacactggatcagtatgatgctgccatgctggattactttaccatgggaatccttcctgagcatcttctggaaggagaggacgtgaataccacatcctttaaccagaatccggtgggaacaggccgttataaatttgaagactgggatgctaccggtggaatgatcacactgaaacgaaatgaagattattacggaaaggttccgaatattgaaaccgttgtatatcgtacagtatcggatgagactacaaaggcaaccatgctccagtccggtgaggcggatcttgcatggctgaattccaactacgcttctcagttcaaggataaggacggatataattactgggagttcaccacagcagattaccgtggagcggccatggatatgagcacagatttctggaaggaaaacggagattccatcggcgttctgaattatgcgctggataaggattccattattgcaggtgttcttgcaggacagggagagccggcatacagcccgatccagagaaaccctctcggaacagataaggaagccaatatctactcctatgatctggatacctttgcaaagaagatggaagagctgggatggaaaaaaggtgatgatgggatctatgagagaaacggacagaaattccactttaccatccaggtacgtgattacgaagaagagcgtgtggatattgccaatgtcatgtctgatatgctgaagcaggctggtgtggaaatggaagtaaagcttgttaccaaatttgactgggatgcaggatacaatggatttcttgccggctatgcaacacagtttgacccggatatggcatatgtaaactttgtaaccgacgcaagtggaaacaacatgcattattccaatgcagatgtggataaatatcttgaggaaggccgtcacggtgagactgaggaagccagaaaagaagcatatagtgaattcgaaaaggcatatgccgaggcacctggaatccttctggttgcttatcttcagggagattatgtaggcgtttccggacttgacggactggataccacacgtgttctgggacatcattccgtaggtgttatgtggaatattgaagactggaccattacaaaataa

SEQ ID NO: 2888 - DNA, 1611 bp, Blautia sp.
atgaaaaaaataatgatcgtagatgataattacttatctgcagaaggtatcgaaaaaaacatagactgggaaacactgaatgcagagatcatccatgtctgctacaatggaacctctgctatcgaagccatgaaaaaagaaccggcagatctgatcatttctgacattgaaatgcctgatcttgacggcatttccatgagccgtcaagctcttgagatcaatcctatggtgaagatcatcctgatcagtgcctatgataaatttgaatatgcaagacgcgctctgctcctcggtgctctggattatatcgaaaagcctctggattatgcctatcttatccagaaggtaaaaaacgcttttgcactgatggaaaaggaacagaaaaatctccagcttctgaagcaaagcaggcctcttcttacggaaaaatttttccgcgagatcacacaccttccgtcttctgaagcagcctaccgactgaagccttatcttaagtatctgaacctggagctgaattatgatttttatacagttgttattctggagcttgaaaatgctccggatctaaaagctgtttacgggattgaaaagtttcagatggagcttttcaaccttcaggatctgataactgaggaaaccgcttctcttgattttgtgtatcttctcccggatatggatggctatctgtgcattctgggacacagcggctgtcagtccaacagcttccgccagcttaccagcggacttatttcatcaatcgcagatgcctgccagccactggggctttctctcaacgcaggtattggaacaattgtccaggatttttggaacctgaaccattcttataaaagcgccgtacatgcactggaatacagattctttttcccgcatcagaatatctttgacggaagagaggccctgggttccgatctgtctgttgcagatttttcagatacaaaggaagatgaactgatccggcttctctgtaaaaaggatacctctgccatagatctctggtttcagaatttttccgactggcttacccagaaatttcgcacaaagaatttcgctttcatacagatttattctcttcttggccggatcctgaaatttttctatgaattaaatctggatacgcatgaccttgaagctaaaattttgtatgtttacaaccacataaatgagtttcataatacggaagagctatgtcaatggctgaaggatctgtgccatcttttatgtcggaagcttgattcctccatgaatgattatcaccagaagctctgcgaactggtgatttcctatatcaacgaacactacactgacaatacgctctgcctcaatgatattgctgcctctgccaatgtaagccctgcttatttaagtgctcttttcaaaaaaaatcagggaatcagtctcagtgactttatcacatctcagcgaatttccgcagccgcccgttacctgactacgactactatgagtctgaaggagatcagcctgaaatgtggttatgccaatcaatattatttcagcaccagcttcaaaaagtggggatcacaccttccgcctatcgggaacagcatacataacttcttctcttctttataa

SEQ ID NO: 2889 - DNA, 1560 bp, Blautia sp.
gacggcaatgcttgtgttgcaacggatattctgctgtttccggcgcagagaaagccggggacagttcagaagatccgcaaacaggaaaggagaaacagatctatgtatgatgtgatcattatcggagcaggagtttccggagcggcagcggcgagagagctttcaagatatcggctgaaaatctgcgttctggagcgagaagaggatgtatgctgtggaacttccaaggcaaacagcggaatcgctcattccggttatgatgcagaaccgggaagccttatggcggaactgaatgtgaagggcagcaatatgatgggacagctttcgaaggaactggattttccttttaaacagactggttcactgactgtctgtacgactgagaatggaatcgccatgctgcataagctgcgtgaaagaggaatgaaaaacggagtagagggactaaggatccttgacagagaagaagcacttgccatggagccgaatctgtctgatcaggtgctggcagcgctgtatgcaccgacagccggaattgtctgtccctttgagctgaacattgcaatggcagagaatgcatataacaatggtgtggaatttaaatttgacacagaagtaaagaacatccgaaaacaggaaaaaggttttgttgtggaaacctcaaagggtgattttgagacaggctgtatcgtcaatgctgccggtgtctatgcggatgtttttcataatatggtaagtgagaaaaaactgcatatcactcctcgtaagggtgagtatatgcttcttgataaaagtgcaggaacacatgtgaatcatacgatctttgcacttccaaataagaacggaaaaggagttctggtaacacagactgttcatggaaaccttttgatcgggcctacagctacggatctggaggatcgggaggaaacagcgactacctcagagggggtggaggaagtaagtgccaaatcccggaaaacagtaaaggatattccactgcggaaggtgatcacaagctttgcagggcttcgagctatcgaggacggtatggattttgtgatcaaagaggtggaggatgctcccggatttatcgattgtgcaggaatcgcatccccgggacttaccagctcaccggccattggctgtatggttgctgacatcgtaaaagaaaaattacatccggaagtaaatccggattttgatccggtgagaaaagggatcctggatccgtcagagctttctctggaagaaagaaatgagctgatcaaaagatcaccggaatatggaaatatcatctgcagatgtgagatgatctctgagggagagatcctggatgcgatccgaagaccgcttggagcgaaatccctggacggagtaaaacgtcgtacaagagcaggaatgggaagatgtcagtcaggcttctgctctcccagaacaatggaaatcctcagccgagagcttggcatttccatggaggagatcacaaaaacaggcggagcttccagactgatcgaaggaatcaacaagaaaattgcagaggagggcgagaaccatgaatga

SEQ ID NO: 2890 - DNA, 1368 bp, Blautia sp.
atgaaattgacaaaggacaagaccaatgatatgaccgtgggaaatccggtgagcctgatcatccgctttatgattcccatgtgtctcggaaatatttttcagcagttttataacattgcggattccattgttgcgggtcagttcctgggagtagatgcgctggctgcaatcggaagcaccggttcactgatgttttttgttaccggatggcttaacggactgagcagtggctttgccattctggtatcccagtggttcggggcgaagcaatatgataagatgcgtcattacgtagctatgtccatttatctggcagcagcctttgccattgtgatgaccattggctttgaggctttgaatgaaccgattctgcggctgatgaattcaccggaggatctgatgggatctgtgaagggatatatgggaattatttatgcaggcctgatcgtaacagcggcatataattcactggcagcgtttctccgtgcacttggagattcaaaatctccgctgtattttctgatcatttcggcagtgatcaatgtgttcctggatattctgtttattgtaaaaatcgggatgggagtggaaggctgtgcctatgctacagttatcgcgcaggcaatttccgcagtctgctgcctgatctatattatcaaaaagttcccgatcctgcatctgaagaaagaaaactttgaagtttcttttaccagcttccgttatctgctggcccttggtattcccatgggacttcagttttccatcacagcgatcggaaccattattgtgcagggtgcggtaaatatttacggttctgtatatatggcaggattttccgctgcgggaaaaatacagaatattattgcaactgtatttgtagcttttggtgcgacgatggcaacctatgtaggacagaaccggggcgccggaaagatggaccgtgtaaaagcaggaatgaaatatacccagatcatgatcctgatctggagtttgatcactatgatcattatgttctttttcggaaagtacatgacctggttatttattgacaaatcccagacggatgttattaatgtttctgttacttattttcatacggtattctgggcatatccgttccttggaagtatctttctctacagaaacggacttcagggactgggatatggcttggttcccatgctgggcggtgtgtttgaactggcggcaagaagtgcgatcgttatgtttgttgcaggaaaaacaagttttgcaggtgtatgtctggcagatcctgccgcatggatcgcagcgctgatccctctgatcccgtattatatttatgtgatgaaaaagtggagcaggggaaaaaaggaaactactgcctga

SEQ ID NO: 2891 - DNA, 3546 bp, Blautia sp.
atggcaagaaagatgaaaaccatggatggtaaccatgcagccgctcatgcatcatatgctttttctgatgtagctgctatttacccgattaccccttcatctgtaatggctgaggcaacagacgagtgggcaactcagggaagaaagaacatctttggacaggaagtacaggttacagagatgcagtctgaggctggtgcagcaggtgctgttcacggttctctggcagcaggtgccctgactacaacctacacagcttcccagggtcttctgcttatgatcccgaacctttacaagattgctggtgagcagcttccgggagttatcaacgtatctgcccgtgcacttgcttcccacgcactttgtattttcggtgaccattccgacgttatggcctgtcgtcagactggatgtgcaatgctttgtgagtcttctgtacaggaggttatggaccttacaccggttgctcatcttgcagcaatcaaaggaaaagttccgttcatcaacttcttcgacggattccgtacatctcatgagatccagaagatcgagacatgggactatgaagatctgaaagatatggcagatatggacgcaatcgcagagttccgtaaccgtgctctgaatccgaaccatccatgtcagagaggttccgctcagaacccggatatcttcttccaggcaagagaggcatgtaatccatattatgacgctcttccggcagttgttcaggagtatatggacaaagttaacgagaagatcggaacagattacaaactgttcaactactacggagctgctgacgctgagcacatcatcgtagctatgggttccgtaaacgataccatcgaggagacaatcgattaccttatggcagctggtaagaaagtcggtgttgttaaagttcgtctttacagaccattctgtgcacaggctcttatcgatgcaatcccggatacagttaagcagatctctgttcttgacagaacaaaagagccaggagctcttggcgagcctctgtatcttgatgttgttgcagctcttcgcgacagcaagttcagcgatgttaagatctttacaggacgttacggacttggttccaaagatacaacacctgcacagatcgtagcagtatatgagaacactgagaaagagaaattcacaatcggtatcgttgatgatgttacaaacctttctcttgagacaggtgcaccacttgttacaacaccagagggaacaacaaactgcaagttctggggacttggagctgatggtactgtaggtgctaacaagaactctatcaagatcatcggtgataacacagacatgtacgctcaggcttacttcgattatgactccaagaagtccggcggtgttacaatgtctcaccttcgtttcggtaagaaaccgatcaaatccacatacctgatccacaaagcaaacttcgttgcatgtcataatccgtcctatgttaacaaatataacatggtacaggagcttgttgacggaggtacattccttctgaactgtgcttgggatatggaaggacttgagaaacatcttccaggacaggttaaagctttcatcgctaaccacaatatcaaattctacaccatcgacggtgttaagatcggtattgagactggcatgggaccaacacgtatcaacacaatccttcagtccgcattcttcaaacttacaggaatcattcctgaggagcaggctatcgagcttatgaaagccgctgctaaagctacttacggacgtaagggtgatgacgttgttaagaagaactgggcagctatcgatgccggtgctaaacaggtcgtagaggttcaggttccggagagctggaagaacgctgaggacgagggactcttcatgtctcacgcatcccacggtgctcaggaagctcaggacttcgtaaacaacatccagtgcaagatcaatgctcaggaaggtaacagcctcccggtatctgcattcaaggattatgtagatggtacaacaccatccggaacagctgcatatgagaaacgtggtatcgcagttaacgttcctgtatgggttccggacaactgtatccagtgtaaccgttgtgcatatgtctgcccgcatgctgcaatccgtccggttgccatgacagcagatgagacagctaacgctccagagggaatcaagacacttccgcttacaggaatgaaagactatacattcacaatgactgtatccgctcttgactgtacaggatgtggttcctgtgcaaatgtctgcccaggaaagaaaggcaacaaagctcttgagatggctccacttgaagctaacgcaggagagcagaaatacttcgattacggtgtaacacttcctcagaaggaagacgttatcgctaaatataaagagacaactgtaaaaggcagccagttcaaacagccactccttgagttctccggcgcttgtgcaggttgtggtgagacaccatacgctaagctgatcacacagctctttggtgacagaatgtacattgcaaatgctacaggatgctcctctatctggggtaactcttcaccatctacaccatacacaacaaacgctaagggacagggtcctgcatggtccaactctctgttcgaggataacgcagagtttggttatggtatgcttcttgcacagcgtgcgatccgtggcggtctgaaagaaaagatcgaagaccttgtagctaacggaacaaacgaggacgttaaagcagctggtcaggaatggctggatacttacgctgtaggcgcaacaaatggtgcagctacagagaaactcgttgcagctcttgaggcttgtggatgtgacaaggctaaagagatccttgcacagaaagacttcctctccaagaaatcccagtggatcttcggtggtgacggatgggcttacgatatcggattcggcggtgttgaccacgttctcgcaagcggacgcgacatcaacgttatggtattcgatacagaggtttactccaacacaggcggacagtcttccaagtctacaccgacaggtgcgatcgctcagttcgcagcaggcggaaaagagactaagaagaaagatatggcatctatcgcaatgagctatggctatgtatacgtagcacagatctccatgggtgctgacttcaaccagactgtaaaagcaattgcagaggcagaggcatatccgggaccatccctgatcattgcttatgctccatgtatcaaccatggtatcaagaaaggtatgagcaaagctcagacagaggaagagctggcagttaagtgcggatactggcacaacttcagattcaacccggctgctgagaacaagttcagccttgattccaagacaccggatatggagaactatatggacttcctgaacggtgaggttcgttacaactctctgcagcgtcagaatcctgagaaagctgctagactgttcgctaagaacgagtctgaggctcaggctagatatgagtatctgcagaaacttatcactctttacggagcagataagaaagaagactaa

SEQ ID NO: 2892 - DNA, 1176 bp, Blautia sp.
gtgatatcagaagggagaatagaaacaatgaaattaagaacacagaaaataacagcacttatggcagcagcggtattaggaatatctgcatttggaagcgtaccggtaacagcggcagaaagcacggaaacagcagatatcggagaggcaatggcggtggatggagaggcagtttcatcagatctggtagcaggtacatttaagccttccgacgtaacctgcaaggcacaggattcttatgaatatccgtttctgggactgaagctttcactttcgaaggaactgttaaagcagatcaaggatcagagcattgcaatgcttactacggaagattttgagaatcagaccaatgcagtgacatatgcatatgtaagctggagcaaaatgacagaggaacagaaaaacgccgaaatacagaagatgggaacaggatatgacgactgggtggcaggtctggacagaattggcacaattggcgtttatgacgaagcttcacagaaaaagctggatgagatcactggctgtacagagcataaagagcttggaagcagcagtgacgggaaatacaaatattatctgagcacaaacaaagatgccgatgaaaagctgacaaaggagctggaaaagattaaaaccgacattacggaaatgacaccgtatcagaatatttccgtgtttgagcagccacaggataccagcgtcaacccggaggatgtaaaatctgtaggaaaatttgaaacaacaggaatagatggaaaaacatatacagaaaaagtattcagtgactatgacctgacgctggtaaatatttttacaacctggtgctcaccatgtgtaaaagagattccggaacttcaggagctttataaagaaatgaaagataaaggtgtcggagtagcaggcgtggtgcttgatactacagatgaaaagggaaatcaggacgaggaggctgtaaaaaaagcaggcattcttcaggaaaaaacaaaagcagagtatccgttcctgataccggatactactatgatgaacggccgtctgcaggggatttccgcatttcctgaaaccttttttgttgacaaagatggaaacattgtaggcgatacctatacaggaagccatacactggacgaatggaaggaaatcgtggaaaaagagcttaaaaacgtttcaaagtaa

SEQ ID NO: 2893 - DNA, 849 bp, Blautia sp.
gtccggctgactagacagctttcgaatggagtgagtgtggcctgcggcgttcgtgcaaggcaaaatgaagtgatgcgctattggcgttatcaccggcagaaaataatgttacaacaggaaaggagcaaatttatgggcggaattctcggagcatgtaatgcaatatcggattatttgcacactttaaatatgggatcgacgctgtttcggctgattcttgcaatgtttcttggatgtctgatcggtattgatcgtggaatgaagaagcgtgtggcaggtgtaaaaacacatatgatcgtctgtatgggggcaactttggttatgatgacgggcgattttatccatgtatattctaatggggcaggaatcggagatactgcacgacttggcgcacaggttgtcagcgggattggttttcttggagtgggaactatcattgtgaccggacagagacatgtatccggtcttacgacagcagccagtctttggacttctgcgtgtatcggacttgctgtgggaatcggcttttacagcggtgcgatctttaccacgctggggcttattctggtgttcaaatatgcgaaatatatagaggtttatgtggaagagcattccaatacctatgacgtatatatggagtttgaaaatgaagacaagatgagtatggtcataaagaagctccgggaagaggacatcatgatctccaacgtagttatcatcaaaaagagatccaaaacacagagtgtggtgatccaggcaacaatggaggctgccaaatggaaagcacgccatactgtatttcgcgaggtaaggcagcaggaaggagttatttccgtggaggaaatatga

SEQ ID NO: 2894 - DNA, 897 bp, Blautia sp.
gatcatttctgcaatgcagttgactatcacagggaaaaaggaggagcagctgtaatgaaaacgaaagtaagagaaaaagcgaactggccggtaacgatccttctgatccttggccttatcacagtggtatttccgctttatatgacaattgtgatcgcattcaagcagccgacagagatgaccaacagtgtagccgggatcctgtctctgccagagaaattcagtcttgccaatttcagggaagctatggaggtaacagacttctggcattctcttggaaacagtgtattgatcactgtgatcacagtggttcttgctattgtaattcattcacttttaggttatgctatagccagaaacaagagaagtaaattttataaatttatctatctctatgtagtgagcggtatgtttgttccgtttgctatcctgatgatgccgcttgtaaagcagactgctgagatgggccttgataacaaagtcggtgtgatcattctttacacggtattttatatgcctatgaacgtgcttctttattccggatatctgacaaacattccaatggcccttgaggaggctgcctgtgtggatggagccagcacctggaaaacatattggaagatcatctttccgattatgaagccgatgcatgccacagtggcagttctgacagcacttggaacctggaatgatgttatgactccattggttatcatgtccggatctacgggtggaaccacattgcctctggcacagctgaatttccagactcagttcggaacaaactataaccttgcgtttgcctcttatctgctggcactgcttccgatccttctgttttatctgatctgccagaagcacattttaaatggtgttgtaaacggtgccgtaaaataa

SEQ ID NO: 2895 - DNA, 1863 bp, Blautia sp.
atgaaattccacaaatgtatcccacccattttttcctcatttcgctataagctcctgctcgcatttctgatcgcaactatggtacctctgatttccctgaccttcatcagctatcacatttcctataacattgccagagatcgtatcatcgattctgccgtaatgactgacaagcagctggtctctcagctgaacgaccgcctcggtcaggttgaaaatgtagcagataccatacagtttcaaatgtactccctaaatcagccttcctctaataaggtagatgcactgaaaaaattcaccactgtaaaaaacaatatttcgctgtataaatccacattcgatttcttccatatatatgtttttctgcagcccgatcagctcggttcaaaagaaagcctgtacttcttttccacagatgagctttctgcatatggtctggataaaaatattgtttccggttcaggcttttcctctgtctggataccggtttccaatatgcctctgcctaaaatactgtccacaaaaaaatcatctgccgatgtgatcctctgcgtccgggcactgaaaaatcaggccaccggtattctggaatacgcctacggcattgctctggacacctcagagcttaccacttatctgcagcctgctgctttggattcccgcatatacagctacattctcacagatcacggagagattgcagcaaaaaatacatcctcactgaatttatccggaatttccaaagcacagtttcagaaactcaaaggaaatgcagattcttcttttcacagcggcgacaaatattataactgctgcaccttaagcaatggctggcttcatgttaccgaaatcccggaaagctatattcagggcaacacgcacatcctgatccgtgccttactgatcactgtccttattttcttgctccttactgttatcatcgttatcctgttttccgaaaatcttacccggaagatcactgcactttcctatgcaatggaagcctttcagctgggatatgacccggaacatctatctatcgttactgttccccacccggatgatccttccaggtatgatgagattgacagactgggcatcacctttgaagatatgcagcacacaatagccggaaacctgaagtccattgtaaatctttccgtaaacgaagaacgtctgaaataccagctgctccagtcacagatcaatccgcattttctttacaatatcctgggatcgatccgtacctgccagtcccttggaaagcttgacattgctgatcagatgattgcaaatctgactgccttttaccgtcttaccctgcgtaaatcaaaggaacttattcctattaaagatgaattggaaattgcccggctttatctggaaatggaaaagctctgtcataaagataatctggactgggagatcgaagcagaagatggaatcgaaaatttcctgatctgcaagtttacacttcagccatttctcgaaaattccattctgcacgggatttcttcgggcacaccagctgttttcatttcgatccatgttctttatggcgatgatacggttgtgatctccattgaggacaacggtgccggcatggactctgaaacccttgcacagctgcgccatgctattgagcataatgttattgattatgagaagcattttggaatttccaacgtaagttcccgtatttccaacccattatacggaaacggttccgtaaggatccgcagcaaccccggaaacggcacatacgtcaccattgaattcgaacagatggaggaagatatcgatgaaaaaataatgatcgtagatgataattacttatctgcagaaggtatcgaaaaaacatag

SEQ ID NO: 2896 - DNA, 2124 bp, Blautia sp.
ttggctggaaaagaaggaagagaatatccattagagagaaccagaaatatcggtatcatggcgcatatcgatgctggtaaaacaactcttacagagcgtattctttattatacaggtgttaactacaagatcggtgatactcatgaaggtacagcgacaatggactggatggagcaggagcaggagcgtggtatcacaatcacatccgcagctacaacatgtcactggactcttgaggagaactgcaagccaaagccaggtgctcttgagcatcgtatcaacatcattgatacaccaggacacgtagacttcactgttgaggttgagcgttcccttcgtgtacttgatggtgctgtcggcgttttctgtgctaagggtggtgttgagccacagtctgagaacgtatggcgtcaggctgatacctacaatgtacctcgtatggcattcatcaacaagatggatatccttggtgcaaacttctacggtgcagtagagcagatcaagactcgtcttggtaaaaacgctatctgcctgcagcttccaatcggaaaagaggatgagttcaaaggaatcatcgatcttttcgagatgaaagcttacatctacaatgatgagaagggtgatgacatttccatcacagatattcctgaggatatgaaggaagatgctgagctttatcatacagagctgatcgagaagatctgcgagctggatgatgacctcatgatggagtaccttgagggagaagagccttctgtagacagaatgaaagctgtcctcagaaaagctacctgtgagtgtacagcagtaccggtttgctgcggttccgcttacagaaacaaaggtgttcagaaacttctggatgcaatccttgagtacatgccggctcctacagatatcccggctatcaagggtgttgaccttgacggcaacgaagttgagagacattcatctgatgatgagccattctccgctcttgcattcaagatcatgactgacccatttgtaggaaaacttgcttatttccgtgtttattcaggaacaatgaactccggttcttatgtactgaatgccacaaaagataaaaaagagcgtgttggacgtatccttcagatgcacgctaacaaacgtatggagctggataaggtttactccggtgatatcgctgcagcgatcggattcaaattcactacaacaggtgatacaatctgtgacgagcagcatccggtaatccttgagtccatggagttcccggagccagttatcgagctcgctatcgagcctaagacaaaagctggacagggcaaacttggtgaggcacttgctaagcttgctgaggaggacccgacattccgtgctcatacagatcaggaaacaggacagaccattatcgctggtatgggtgagcttcacctggatatcatcgttgaccgtcttcttcgtgagttcaaggttgaggctaacgttggtgcacctcaggttgcttacaaagagacaatcaccaaatctgttgatgtagacagcaagtatgctaaacagtctggtggtcgtggacagtatggtcactgtaaagttaaattcgagcctatggatgccaacggagaagagctgtacaagttcgagtccacagttgttggtggtgctattccgaaggaatacatcccggcagttggcgaaggtatcgaggaagctatgaaagctggtatcctcggaggattcccggtagttggtgtacatgcaaatgtatacgatggttcttaccatgaagtcgattcttctgagatggcattccacattgcaggttctcttgcattcaaggatgctatgcagaaagcagctccggttcttcttgagccaatcatgaaggtcgaagttactacaccagaggattacatgggtgacgttatcggtgatatcaactcccgtcgtggacgtatcgagggtatggaagatatcggcggcggtaagatgatccgtggatatgttccgctttccgagatgttcggatacgctacagaccttcgttccagaacacagggacgtggtaactactctatgttcttcgagaaatatgagcaggttccgaagtctgtacaggagaagatcctttccaaaaagggctga

SEQ ID NO: 2897 - DNA, 1686 bp, Blautia sp.
atgatgaaaaaaagaatgaaggcattattggcaatcgggctttctgcaattataatggtatgcagtgccggatgtggaaatggaaaagaacacatgaaagcagaaatagatccggatatcccggtggaagatgtgtcatttcctctgaaagaaaaagcagagctgtcttttattaccagtgcacctgcaacatctacacaggaacctaatgaaagaacgatttttaaaagactggaaaagcagaccaatgtccacattgactggacctgttttgtatcggatcagtttaatgacaaaaaaaatctggcgctggcacagttcggaaatcttccggatggactttttaacgcagggatgagtgattatgatcttcttcgttatgccaaacagggaatcattattccggtagaaaatctcattgataaatacatgccgaatcttaaggctgtatttgaaaaatacccggaatacagaacaatgtgtacagcaccggacggacatatttattctttcccatggatcgagcagcttggtgcagggaaagaagccattcaggcaattggagatattccctacattaataaaaaatggctggattatctgaagctggacgttccgactacaactgaggaactggaacaggttctgatcgctttccgcgacaatgcagataaactggaaaagaaattcaacattgagggtggtgtgatcccgatgtcctttatcatcaataatggtgatcaggatcctgcaattctcatcaacggattcggagaaggatatggtgacaccggtgatcattttgcagtgaaagatgatggaaccgttatttatacaactgtacaggaaggctataaagaaggtattcagtggctccatcagctggtagaagaaaagctggtggatccggaggcttttacccaggaatggtcaacttatgttgcaaaaggtaagaaccacagatatggtctgtgtttcacctgggatattgcaaatattgataacaatgaagattatgtaatgctcccggcgctggccggtccggatggtcttgtaaatattacaagacagaataacagtgaaaccagtggctttgacagaggacgctgcgttctgactacaagctgtcgaaatacggcactggcagcagcatggatcgatcagatgtatgaaccgatccagtctccgcagaataactggggtacttacggggaaaaagattcatttaatatctttgagatgtccgagaatgcagaaggtggtcagatgctgaaacatatggatctgggagatgcatctccggtagaggttcgtgaagcacagtctgtaaacggaccgttggcaatacttaacgagtattacgatgtatatgtaacagagccggcagatgcaaaatggcgtctcgacaatatgcacgaaacatatcttaaggatatgaacagtaaatatgtgtatccgaatgtatttatgagtattgatgataccaataaggtatctcagtacgacacggatatcaagaagtatgcggaacagaaaaaagcagactggatcctgaatggcggcatcgataaagaatgggattcctatctgaaaaagatggagcagtatggactgtctgattatctggcaatcaaacagaaatattttgaccagtatcagaagtctcttagtgagacagagaaataa

SEQ ID NO: 2898 - DNA, 1140 bp, Blautia sp.
atgaaacaaaacagtatgttagcaatgatcctggccggtggaagaggaagtcgtcttcacgagttgacgaataaagttgccaagccagccgttggttatggcggtaaataccgtatcgtggattttccgctcagtaactgtgccaacagcggcattgatgtcgtaggtgtactgacacagtatgaatcagttttactgaacagctatgtagcagccggtggccgctggggccttgatgccaaggacagcggagtttatgtacttcctccacgtgagaaggctgatgccggtctggatgtataccgtggaacagctgatgcgatctctcagaatattgatttcatcgactcacagaacccggaataccttctgatcctttccggtgaccacatctataagatgaattatgcaaagatgcttgatgaccatatccagcataaggcagatgcgactattgcagttatcgaggttcccatgaaggaagccagccgtttcggtatcatgaacaccggtgaagatgaccgcatcgtggaatttgaggagaaaccggaacacccgaagagcaatcttgcctccatgggtatctacatattcaactggaagcttctgcgcaagctcctgctggcagatatcaaaaatccggattccaatcacgatttcggtaaagacatcatccctacactccttgcacaggacaaagcactctacgcctacaagttcaaaggctactggaaggatgtaggaaccatcgattccctctgggaagcaaacatggatcttctcagtcctaacagtgaactggatcttaacgatcctacctggaaaatctacactgaggatgctacctctcttccacagtatatctgtgatacagctgtgatcaacactgctttcattactcagggctgtgttgtagaaggtgagatcaccaactccgtacttttcacaggcgtcaaggtcggtcctggtgccaagatcatcgacagtgtcctgatgccgggtgttgttgttgaagcaggtgccgttgtccagcgtgctctcgttgcagacggagtcgtgatcggtgccaatgctcgtgtcggttccaaggacagtgagcacatcgaacttgtatcaaaacgtgtaaagggggctgagtaa

SEQ ID NO: 2899 - DNA, 1872 bp, Blautia sp.
atgacttttcctggcacatcatcgaaatacggttggaaattatttttagaggccagtagtgctttattgttaaaactgcataaaaaaaacagaaaagtttggcagaaatttaagtttcacgagaaacctgttgattttaaatggtggataggatatgctgatttcagaatcaacagaaaaaggaggccatttaccatgaaaaaaaactggtggaaagaaagcgtggtatatcagatttacccgagaagttttaaggacagcaacggagacggaattggtgatattcccgggatcatagaaaaactggactatctgaaagaactgggagtaaatgttctctggatctcacccatgctggaatctccgcaggatgacaatggctatgatatttccgattaccgcaggatctataaagaatatggaaccatggaggattatgaaaagcttcttgaagaagcgcataaacggggcattaagatcctcatggatctggtcgtaaaccatacttccgatgaacataactggtttattgaaagtaggaaatccaaagataatccttacagggattactatatctggagagagccggtgaatggaaaagaaccgaataactggggaagtgcgttcggaggacctgcatgggagtatgatcctcagacagagatgtattatcttcacctgttttcaagaaaacagccggatctgaactgggaaaatgaaaaggttcgtcaggaagtttacgatatgatgaatttctggtgtgaaaaaggaatcgacggtttccgaatggacgtgatcagcatgatctccaaggatcagtcatatccggatggagaaatgaatggaggattatacggtgattttggtccttactgcgtccatggcccgagggtccatgagtttcttcaggaaatgaacagagaggttttatcccgatacgatgtgatgacagttggagaaacctccggtgtgactatcgaagaggcacagaaatatgcaggtgaggacagaaatgagctgaacatggtgtttcagtttgagcatgtagaggatcagggatcagaccatggtaaatggactaccgagaaatacgatttccaggaatttaaaaaggttatgatcaaatggcaggaagagcttgcgggaaaagcatggaacagtctgtttcttggaaatcatgaccagccaagaagtgtttccagatttggaaatgataatccggcatacagggaaacttcagccaagatgctggcaacctgtcttcatatgatgcagggaactccttatgtttatcagggagaagagcttggaatgaccaatgcttattttacagagcttaaggattatcgtgatatcgagagtattcagtatttccatgaatatacagaagcaggtatttatacaccggaatatatgatgaagtgcctgatgctgagaggacgtgacaatgccagaacaccaatgcagtgggaggattctcatcaggccggctttacggagggaacgccatggatcagggtaaactccaattataaggagatcaatgcgaagcagcagctttcagatcctaattctattttccattattatcagaagctgatccgtttaagaaaagaaaaaccggtgatcgtttacggcacttttgaggcactttacagagatcatgatcagatttttgcatataccagaacccttgagggagagaagcttctcacagtctgcaatttcagtgagcatgtggcagaaatggaaattccggaagaatttcagaaaaatgcagaatgtctgatcacaaatcttggaagaaaggattttggaaagaaagtggtcctgaaaccttatgaggcatttgttctttacagaaatctgtaa

SEQ ID NO: 2900 - DNA, 1521 bp, Blautia sp.
tctttccgttttacattcaaatcccaaggaaacacaagcgaaaatcaaacagcacatagacatgctttaacatgtctgtttttggtgtgcgtgttttgtgcgaaactatgtgaggaggatgagaaaatgacaaaaagaaatcaggatttttcaaaagatattctgagtctgatccgaagcagtgtttctccggcagttttaagtgaaaggctgcaggatttccacgaaaacgatctggcggaagtattaagagaattaagcactgcggagcgcagcagactataccgtatcctggaaagcagtatgctggcagatgtttttgaatatctggaggaagaagaaactgtacaatatctggaagagatggatgtaaaaaaagcggcagccattctttccaaaatggaaaccgatgccctggcagatgttttaaagcagatcgataaagaaaaacgcaagcttctgatccagcttctggatgaacaggtgcggaaagatattgaaatgatccgctcctttgatgaggatgagatcggaagcagaatgacaacgaattgcattgtgatccgtgaaaacctgaccgtaaagcaggccatgagtgagctggtttcccaggcggcagataatgataatatttctacgatctttgcagtgacggacagaggggagttttatggagccctggatctgaaggatctgatcacagcaagacaggaccaccctatggaagagctgatcgtaacttcctatccatatgtgtatggtactgagcagatcgacgactgtatggaacggctgaaggattattctgaagattccattcctgtactggacgatgacaatcgtttccttggagtgatcacatccgcagggatcatcgatctggtagacgatgagatgggagaggattatgcaaagctggctggtctgactgcagaggaagatctgaaagaacctctttttgaaagcatgaaaaaaagaatgccctggctgatcgttcttctgggccttggtatggtggtatcttctgttgtgggaatgtttgaaaaagtagttacctgtctgccgatcatcatgtgctttcagtctctgatcctggatatggcaggaaatgttggaacccagtccctggctgtaaccatccgtgtgctgatggatgagacgctgacgggcagacagaaagcagagcttgtgctgaaggaaatgcggatcggtctttgcaacggtggtctgctcggtattctgtcttttgtactgatcggattgtatattttcttattcaaaggaaaaacactcgtatttgcctatgcggtatccggctgtatcggattatccctgctggtggccatgctggtatccagtgcagtgggaacctgcataccgctgtttttcaaaaaggttggtgtggacccggcagtagcctcaggtcctctgatcactacgatgaatgaccttgtagccgtgataacatactatggaatgagctggatcttcctgatcgagatgttccacctggctggctga

SEQ ID NO: 2901 - DNA, 2484 bp, Oscillibacter sp.
atggacaacactgtaatgaacgcaacggcaagcccctttttggaattacagaaaatctccatgattttcgggcacacggttgcgctcaatgaaatggatttttccatccgcccgggtgagatcgtgggggttgtcggctccaacggcgcgggaaaatccaccttgatgaaggtcattaccggcgtatatacgccttctgccggatcgatctgcctgggcggcgaatccatcaaccccaagcagtatacggccaacgaggccaagcggcggggtatcgcctgcgcatatcaggagctgtctttgtgcagcaatctcaacgcatatgaaaacttctccatcagccacatggaccattctcccctggggcgtcacggatggcgcaaacgggcggaagcctttgcttcggaaacattggaggcaattttcccccataaccacatcgacatcaaaacacccctgagcgagctgaagctttcccagaggcaaatgattgagattgcaagggccatctccaccgacggactgaagctgctcatactggatgaacccacagcttccctcacggcagaccgcatcgatcagctccatgcccacatgaaaaaactcagccaagagggaatcgccatcatttacatctcccacaagctggatgaaatcgaccgcatctgcgaccgcattgtggtcatgcaagccggtaagaacattctctcctccagcattgccgatattacccccaaggaattgattgaaatcatgggcggaaaggcagaaaccgcttcccattccaaacgcaccgaccacagcgaggctcccgctgttctgaccatccagcatctgaataccgatgccctgcatgatatcaatttgactgtccaccagggagaaattatcggtgtttccggtttggccggctccgggcagaaggagctgctgctggcgattttcaacgcccagaaaaagcggcaaaaggcaattcagctggctacgcgggcctcctttgtcagcggcgaccgcaacaatgagggaattttccccctctggaacattgcggacaacactctgatctccagtcatgagcaagtcagttctgccggcattctcagccccaagcgcttcgcttccctggctcagtattggtacgataagctgaaattcaaggctgccggaatcaaagacgatattaccagcctgtccggcggcaaccagcaaaaggcgttgattgcccgcggaatctgcgccgatgccggaattatcatcctcaatgactccacctgcggcgtcgatatcgaaaccaagcaggaaatttaccggctgctttacgaagcacgcagcgaaggcaaaaccgtcatctggcacagcacggaagacttggaaatggagctgtgcgaccggattctggtcatgcatgagggccgcattgtccgggaactgcagggagaggacgtcagtgtaaaaaatattgtcacaacctcttttgaatacgcacggaaaagcaacgccgagcaggaacagactgccgactcccagaaaaagcgctccttcctgccaaaggtcaaaaagattctccaaaaccgcgccacgctgcctatttttgtcatggcgctgattttttccatcaactcttttatcaatcccaatattgcttcttaccgcggcatcaatatgctctacagttctgccgtccccctggtcttcattgcactcgggcagatgttcctggtcatttcagggggcattgacatgggcaacggcattgctgtgggcctgaccaacgtgctctttgcatttgtggtctcacagtcgcccataaccggtgttctgggccttgcgctgtttataatcgcctacggcgccttgggtgctttgatttatgtaaagcgtatgccggccattgtcgtgacgctgggtgcctcgtacatctggcggggcatcggcctgatcatagcccccaaccccggcggcacacagccggcatttatcgacgccattttcggattccgctgccccattattcccacaccgatcctgatggccattgcagcgggactcctttgctggtggatcaccaagcgctccaagtacggattgatcatctgcggatgcggcaataacccaactgccattgcccgtgccggctggtccaggctcattgccaccgtcgtaacctatatgatttccggagccctgattgtgctggcgggcatgtccatgacatacctctccaagggcggcgacatcaattccacctctacataccagatgctcagcatcgcgaccattattctgggcggatgcgaatttgtgggcggaattgcctctccggtgggtgtcaccgcagccgcactggccatttccagcatctccacccttttgaccatgatcaatgtggattccaacctgcagagtgcggttacgggactcatcctgatcgcagcgctggcaatcaagctggtaccaaccgtagggaggcgtaagacgacatga

SEQ ID NO: 2902 - DNA, 993 bp, Oscillibacter sp.
atggaaaaaagcactcttggaaacagtggcattcttgtctccgggctttctcttggaacctgggcctttgcaggcggaaaactgtggggcgcaagcgatgaccacgcagcaattcagacaattcattatgcgttggacaacggaatcaatctcatcgataccgccgagcgatacggcgacggaaaatccgaggaagtcgtaggcgcggcattgaaagaccgccggtcccgcgcgattcttgccacaaaagtatacacggatgcgctgcgctaccaggacgtcatcgcgcattgcgatgccagtctgcgccgcatgcaaacagactacattgacctctatcaaatccactggccaagtcccaccatccccctggacgaaacgttcggcgcatttgaggacctgaaaaaagccggaaagatccggatatccggcatctgcaatgccggtgtatcctgcgtgcagtctttgaaaagctcctatggtgtggccatgaatcagctgccatattccctgatctggcgcattgcggaaaaagaaattattcccgccacagagcgcatggggatctcggtctgggcctattctcccctcgcccagggacttttgaccggcaaattccgctccgtggaagatgttccgctcagccgccgggaaacccgtttttatagcggcgactggaagcagggacgtcatcatgatcccggcttcgaaaaagaaatctttgcctttctccaccttttgatcgagaaagcagagcaatccggatatacccccgcagaagtggcgatgaattttttaaagcgccgttcctgtgtcaaaagcattcttgtcggctcccggtccccccagcagctggcccagaacatttccgcctacgaagcggacattcccggcagctggatggatgaaatagaagccgcttcagactctctcaaagccattatgggcagcaacgccgacatgtgggtcggagacggcggccggttcttctaa

SEQ ID NO: 2903 - DNA, 1308 bp, Oscillibacter sp.
atggaagcttacattcctcttgtcatgttcggccttctgatcgttttactggttgttggccttcccattgtctatgcactgtccctggtagccgttggaaccgcttttttcctctggggccctggaagcatttacgccattgtcacctccacaatcacgaccatgaacaactggaatcttttggcaactccgttgttcaccttcatgtcgctgatgctatttgaagccggcattgtagaggacctgtacgaggccttttacagcctcacggcaaaggtccgcggcggattggcgatgtgcaccgttgccgtgggagccctgatgggcgccatgaccggcgttgtagcaggcaccgtgattgccctgaccaccatcgccctgccccagatgaagaagtacaactatgatgaaaaaatttccatgggtgccgttctttccggcggaaccttgggccagctgatcccgcccagcaccaatatgatcgtctacggaaccatgaccggcgtttccgtcggcggactgtttgcaggcggcatgagcgcaggaatcgttctggccattctctattgcatctacatcgcgcttcggtgcggtctggacaaggatctgtgcccagtcatgccggaagaagaccgcaaaggcgcaaaggaaactctgctgggactgaaaaaggtattctggccctgcgttttgattattgtggttctcggcgcgatctatgccggcctggcaacgccaaccgaagccgccggcgtgggctgtgtgggtgccgtggtgattgccgttttgaatcgccgctttacattccagcacctgctcaacgccagcaccggaaccctgaaaaatatcgcaatggtgggcttcatcactctggcagcttcctattttggttcggtctttgtggcaatcggcggcaacaaattcgttgccgaggtcgcatccctgattcccggaggcagccatggtctcatgatcgccctgcttgccattgtgttcttcctgggaatgtttattgataccattgccatcatcgtcatctgcgctcctattttcaccccgctcatcaccagctatggaattgatcccatgtggtttgcggtctgcttcatggtggcgcttcagtgcggttatctgaccccgccgttcggcttctccctgttctacatgaaaagcgccgcttccgaagacactcagctcaaaaccatctatcagtctgccattccctttatcggcgtacagctggttggccttgccatctgcctgttcgccccgtccctcgttttgtgggggctcaatatcatgcattga

SEQ ID NO: 2904 - DNA, 1089 bp, Oscillibacter sp.
atgcagaaatgcagaaaaggagaggtacacttcatggaaaagatgaaaagacttcttgcactggtaatgattatggcttctgttgcagggttgagcgcctgcggcggctccaaggatgctcagacggatgatgcgcagggcggcgatgatggcgatgccgctgagaaaatcgtcattcaggtcggctacggcaacaaccccggcgagcccacggacctggcgatgcagaagtggcaggaactgcttgcggagcgcagcaacggcaccatggagctggaactcttcccctccagccagctgggttctcaggctgacctgacggatcagattgtcatgggtgagccgattatttccatcagcgacgcatcgttcctggctgaatacggtgcccccgaaattgccatcgcatcctgcccgtacatctataattcctgggatgagtgctggaagctgatcgagtccgactggtgggctgagcaggaagcacttctggctgagaacggcatccacatcctcactgccaactgggcatacggtgagcgcaacatcatgaccaccaagcccgtccgttccattgaggacatgcagggcctgattatccgcacgccgaccacgcccagctacatgaaggcatttgagtacatgggcgcggcccccactgcgctggctctgggcgatgtgtacactgcaacccagcagggcacggtggaaggcatggagaaccccctggcaaccctgtacggacaggcctactatgaagtggccaagtacatcactctgaccaagcacgttctgatgcccacgcagtggatctgcaacgaggacttcttccagagcctaacgccggaacagcagcagtggctctgcgagacgggcgacgaggctggtgtgtataacaatcagctgcaagacgagatgttggcgcagtacatggaggacatggaggccaacggcgttgagatcatcgatctgagcgatgaggagcgggccaagttcgtcgaggcgtctgctgcggtatatgaggatcccgtgatcacggctgattggcgcgacggcctgtatgactacgttcgtagcctgatggcctga

SEQ ID NO: 2905 - DNA, 1002 bp, Oscillibacter sp.
tttatggagccaattctcaaactgctgggcgccaatgccaatacctatgaatttgccagacaatatgctgcctgtgtgattgttgtcggagggattcccacggtgctctccaacgttttgtccaatttgatccgcagcatcgggcggtcccgggaggcaggcttcggcattatcctgggcggtgtactcaacattgccttggacccgctgttcatgtttgtactgctgcccgatggacggcaggtgttgggagccggaattgcgacatgtctttccaactgtgtggcgtgcgtgtttttcctgctggtgctgaagcggatgggaagcacgtccatcattaccttcagccccagggtaggactggcccgaagggagagcatcctggcggtatttgctgtgggggtgccctccgccatcacgaccttcctgtttgacctggactatgtcatcattgacaagctcatggtttcctaccacgatctggctctggcagcgatcggcattgtcctgaaagtggagcggttccctctgaatgtgggcattggaatttgccagggcatgatgccggttgttgcgtacaactacgccgccaagaataagcaaagaatggaagacgccattcggctgtcccggaggctggggctgatcattgccggcatcagcgtcgtgctctatgagctgtttgccacacaattcacccgtttgtttatctcagatccccagaccgtggaaatggcggctcaattcctgcgcatccgtgtgctggccacgccgctggtgtttttgagctttttcacggtttatttgttccaggctttcggaaagggacatatttccctgtttttgggcgtgacccggtggctggtgtttaatattccaatgttgtttttgctcaacgcactgctggggatgtacggcattgtctggtcccaggcctccgcagatcttttgacagtggctctgtccattttcatatactgtcggtacaagccgcggatttaa

SEQ ID NO: 2906 - DNA, 1509 bp, Oscillibacter sp.
gtcagtgccgagcaggcaattgcttcgattgccgatggcagtacagttgcagtgtgcggatgcgaaaacattctgctcccggaatacctgctctcccatttggaaaagcgatttttggaaaccggacatccccgggatctgacggaaattcaccccgtgattcatggaatgggcgtaggtcttggcctggagcatttcgctcatgagggcatgacaaagttggtcattggcagcggatacagctacctgaaaacctctcagatgaccaatttgatccgcaacaatcggattccggcctatttgcttcccatgggcaccgtgctgcagatgatttccaatgtggcggcaggagaagcctatacatacagcaaagtaggctttggaacgtttgtggacaatctggtagaaggcggctgtgtcaatcagattgcggagaatacgttctgtacgcatgagaccgttcatggagaggacgtgctttgctaccgcaaccccaaaattgacgtggcgattttgcggggaaccactgcggatgagttcggaaacatcagcctggagcaagagcccatgatgctgggagttcggacgctggcaatggcggcacgggcctgcggcggaaaggtgattgtccaggtgaagcgcctggtcaagcgcggcagcattgatccgcaaaaggtagtcattccgggcatcatggtcgacatggtggttgtggacgaaaatcaggctcccagcggcggaaaaatgaatcctgcactgacaggagaaatccgcatccccatttccgccttggagccgcttcccctggatgcggcaaaggtcatcagccgccgggctgcccgggagatcaccaagcagtgtgcagtggtgaacctgggagttggaattcctgtcaacatccccatgattcaggtggaagacggtgccgaccaggatacgattttcttcccggagcacggtgctatcggcggtgttcccgcggagcgtgcgattttcggtaccaatgtcaaccctgaggcgatcattgactccacggatgtgttccggtactatcggggcggcggcctgacgcaatcgttcctgggctttggcgaattcgatcagtacggcaatgtcaatgtcagcaagttcaacggcatcattccgggctgcggcggattcatcgatattgcccataagacacccaagttggtcttctgcgggtccttcactgccggcggagcaaagattgagattggcggcggccggctgcatatccttcaggagggaaaataccggaagattgtagagaaggtcgaacagattactctgaatggacaagaagccctgaaaaagggacaggatattacctatgtcacggagcgggcggtcttccatctgacccctgcgggaattgaattggtagagtatgcaccgggcgtggatatccaaaaggatattctggacctgattccatttacgattttggtccgcgatccccgggaaatggatgcacgcctgtttgcgtaa

SEQ ID NO: 2907 - DNA, 1281 bp, Oscillibacter sp.
atgggtacaattctgttgttattcggcaccttttttgccatgtgcctgattggagtgcccgtggccatgagcctcggtatttccgccctgatttccggcctgcacgtgggcatcacccccatcgtaatgtgccagcagatctatgcacagctggactcgttcacgctcctggccattcccctgtttttgctggtgggcaatatcatggatcgcggccaaatcaccgaccgtctggtgggctttgccagcaagctggtgggtcacatcaccggcggcctgggacacgtgaacgtggtggccaatatgattatggccggtatctccggttccgccactgctgacgccgccgcactgggcggaattatgatcccctccatgcgcaaggccggttataccccggaaatggcagcggccatcaatgcctctgccgcaaccatcggccccatcatcccgcccagcatcatgatggttacctacggtgcattcggcagcgtttccattgccgcactgttcatgggcggcattgtccccggtgtgctggtgggcctgaccattatgatcgtcacctatatctgggccaaaaagcacaagtgcgtggcagttcaaaagcgcgcaactctgcgggaggtctgggatgccaccaagcgggcttttaccgccctgctggttcccctcattatcatcctgggcgtgctcagcggcattttcaccgctacggagagcggcatgatcgccgtggtctactctctgttcctggtcatgttcgtctaccggacctgcacctggaaggaaatggccgaagtgttcatgaaatcctgcgtagaaagcgccaagcccctgctgtgcgtcggcggcgcaggtgcattcggctacatgatggcctatctgcagatcccccaaatgatgctggatgcggccggtcccattgtcggcaagcaaattccaaccctgctgttcattacgttcctgtacatcatcctcggcaccttcatggattcgatcccggcaatcatcatcttccttcccatcgtgcagcagatgggcactgccgccggaatcgatcccatccacatgggcgtgctggtcaccgtggttttgtgcttcggtctgctgacgcctccctacggcatgaccctgctgctttccgcaggtctggcaggtgtccccaccgtgagcgtaatcaaagagctcaagtacttctatctggtatacctgttggtcatcctcggcatgatcttcattccccagacggtcctcttcctgcccaatctgctgacctga

SEQ ID NO: 2908 - DNA, 1227 bp, Oscillibacter sp.
atgaatgaaaaactccacgaatatgccgctcttttaattcggatcggcctgaatatccaaaagggacagcgtttggtcatctcctccccggtggaatgcgcgtattttgcccggctgtgtgccgaggaggcctacgcggcaggctgccgggaagtggtaatgaactggcacgacgatgccatggcccgtctgaagtacctctatgccgacgacgagatcttcgacaccgttcccctgtggcggcgtcacttcttcaacgatcacgctctggaaggtgccgcgtatctcgccatttccgcctcggatcccgagaatttccgcggcgtggagcacagccgcatcgtccgggcgcagcaggcctccggcaagactctgaaggactttgaccggcttcagatgtgcggcggcttcccctggtgcattgcctcggtgcctattcccagctgggccaagaccgtcttccccgacgtcagcgaggaagaagccatggaaaagctttgggatgccattttcgcctccgtccgcatcagcggtgacggaacctgcgtggaaaaatggcatcagcatctggccacgctccacaaccgggtggaaaagctcaacgccctgaacttccgttccctgcactacaccaactccctgggcaccgatctgacggtagagctgccggaaggacacatctgggaagccggcaacgatgtcacgctctccggtcaggagtatgtagccaatatgcccacggaagagctgtatacctctccgctcaaaaccggcgtcaacggcgtggtatatgcctccatgcctctggttcacgacggctctatcatcgatgggttccactttgtcgtccgggacggcaagatcgtggaggcccatgcccaaaagggcgaggagaccctgcggggcgccatctccgtggatgagggcgccagctacttcggcgagatcgctctggtcccctacgacagtcccatctccaaccagaagattcttttctacaacacgctctttgatgaaaatgccgcctgccacatcgccttcggcgaagcatatccctgcctccagggcggccagaaaatgaccaaggaggagctcaaggctcacggtctcaacgattccatcacccacgtggacttcatgatcggcacgccggacctgtccattgtgggcaccacccacgacggccgggaagtcccggtatttgtcaacgggaacttcgccatttaa

SEQ ID NO: 2909 - DNA, 990 bp, Oscillibacter sp.
atgtttgctctgcttttatccctgacgatggtcttctctctgaccgcctgcggcggtgggaacgaggagtcctccagcggcggcagcgaagccagcggtgaaaccatcaccatcaagctgccgcactgctattcggagggacacccgcttaccgacacgctggaaaacttctttaagcccgagctggaaagccgttccggcggacggctgaccgtggatctctatcccaattccactctggccaccgaggagcagatttacgaaggcctgcgcaacaacacctatgaaatgggtgtcgtgggcaccatcttccaggaccggattccttccgtcgccacattccagctgcctttcctgttttccgactttgaccaagcccgggaagccctctatgaacaggactacggccagcagctcatcggcgatgtggcctccctcggctttacggtcaacggcattgttcccgacggattccgggtcatgacgcttaaccgcaaagcggaaagtctggccgatctcaagggtctgaagctgcggatgcccaacctggaagtcatggtaaaaatcggcgaatgcctgggctgcgccgtgactcccatggccatgaccgaggttttctccgctctggagcagaacgtcattgacggtcaggagaatcctccttccaccatccgcacgcagggctggtatgaaatccaggactacctgctggtttccaaccatgtgttcaccagcttgttcctgtgcgtcaacagcgcgttttatgactccctggatccggagctgcagggcattttggacgaggtcatcgacgaaacctccagcaagatttgggacagcgccaaggaacaggcccaggcggacctggacttcatggatgcggaagccgacattgaggtttactacccctccgataccttcaagcaggaaatgatcgacgccactgcttccatgtatgatgacatgtatgcaacctgccccgaggtggag

SEQ ID NO: 2910 - DNA, 2034 bp, Oscillibacter sp.
gagatcccgggtgatgctccgttgggcgatcggaagaacatggtattttccggcagctttgttacctatggccgggcgaagttcctggtcaccggtaccgggatgaacacggagatgggcaagattgccgcattgctcaagagcacggaagagaagaagactcctttgcaggtgagtctggaccaattcggcaggaagctgtccattggcattttgatcatctgcgcggtgctgtttgccgtgagtgtgtttttgcggcatgaaaacgtgatgaacgccttcctctttgctgtggcgctggcggtagccgccattccggaggcgctttcctccatcgtgaccattgtactttccttcggcacacagaagatggcccgggaaaacgccattatccgtaagctccaggcagtagaaggcctgggcagtgtgtcggtgatctgttcggataagaccggcactctgacgcagaacaaaatgacggtgaaaaagctctataccggtggaaagatcatttccgccgaagaagccgactttcatgatccggtgcaggagccgctgctgcgcacggctctgctgtgcagcgatgcggttgtcagcgaagaaggcgaggtgggcgatcccaccgaaaccgcgttggtccgtttgggcgaggcgtatggatttgatgaaggagatacccgccagcgctggccgcggctgacggaaatcccctttgattccgaccgcaagctgatgtccacggttcatcagctctccggcgggctgatgatggtaaccaagggcgccgtagacgtgatgctggatcggtgcatcatctcgccgcaggagcgggcggatgtggaacgggccaatgagcagttttccaatgagggattgcgggtgctggcgtttggctgtcggactgtggaaagcacggctgtgagtttggaagatgaaaacggtctgacattcctcggcctcattgccatgatggatcccccccgggaagaatccaaggcggctgtggccgagtgtattgctgccggcattcgccccatcatgattaccggcgatcacaagatcaccgcttctgccattgcccgggaaattggaattctgactcccgggaccgaagcggtggaaggcgccgtcattgatgggatgagcgatgaggaactgcggcagtttgttcccaaggtttccgtttacgcccgggtttctccggagcacaagatccgcattgtgcgggcctggcaggatcggggcaacctggtggccatgactggtgacggcgtcaatgatgcgcctgccctgaagcaggcggatatcggcgtagcaatgggcattaccggaaccgaggtggctaaggacgcggcaggcatggtcctgaccgatgataactttgccaccattgtccaggcggtgaaaaacggccggaatgtctatgccaatatcaagcgggccattcagttcctgctttccggcaacacggcgggaatcctgacggtgctctatgcctccctcatgggattgccggttccttttgcagccgtgcatctgctgttcatcaacctgctgacggattccctgccggccatcgcgctgggcttggagccgcacacggatgctgtgatgcatcaaaagccccgtccccgaaacgagggcatccttacccgttccttcctgaccagtgtggcccttgagggattggtgatcgcagtggcgacgatccttgcatttcatgcgggactgcgcagcggcggtgcggctacaggcagtaccatggcttttgcaactctgtgcctgagccggttgttccatggatttgactgcaaatccgacacgcccgtattgctgacgcggcggatgtttaacaaccgcttcctgctgggagcttttgggattggcgtggtattgctgggagcagtactgctggtgcctgccttggagcctctgttccaggtagcgcagttgtcctggagactggtcggtacggttgtggggctggcttttggttccatggccgtgattcaggtgctcaaactgctgcggatg

SEQ ID NO: 2911 - DNA, 1179 bp, Oscillibacter sp.
agaaaggaatggaacaatatgatttcactgctggcgcggctgttgatcaaaccccaggaagatgaggcagctttgcgcaaagcctacggcattctctgcggcgccgtgggcatcggactgaacgtgctgctcttcctgggtaaatttctggccggaaccctctccggctccatcgccatcaccgccgacgcattcaataacctctccgatgcaggcagttcctgcgtgacgctgctgggctttcatctggccggccaaaagccggatgtccaccatcccttcggccatggacgctttgaatacctctccggcctggcggtatcggtgctgattctgctgatgggcttcgaactgggcaaatcctccgtagagaagattctgcaccccgctccggtggactccagtcccctggtcctggcgatcctgtgtgtttccattgcggtaaaactctacatggccctgtataatcaccgtttggggaaaaagctcaactcctccgccatgatggccactgccattgactctttaagcgacagcatcgccaccactgccgtcctggcagctaccctggcggggcagttcttccatgtgatgattgacggctggtgcggtattctggtagcctgtttcattctctggtccggctatggtgccgccaaggagaccatcgatcccctgctgggcacaccgcctacccacgaattcgtctcccggatccgggagctggttctggcacatccgtccatcatcggcattcacgacctgattgtgcacgattacggccccggccgggtcatgatctccctccatgcggaagtctccgcttccgaaaatgttctggagctccacgatgaaatcgacaacgtagagcgggaactgcgggagaaactgggctgcgacgccgtcatccacatggaccctgtggtgaccgacgatgggattacccagcaaacccgccagcgggtggccacattggtaaagtgcattgacgacgacatttccatccacgatttccgcatggtctccggccccacccacaccaacgtcatcttcgatgccgtggtcccctttgggttccgcctgtctgatgaggaagtcgcctccaagatcaagtccgccgtccgcgctctggatggaaactactatgccgtggtcaacgtggagcgctcctatacataa

SEQ ID NO: 2912 - DNA, 1236 bp, Oscillibacter sp.
atgaaggagatcaagattaccggaatttctgtagaggaccggcgattccccctggaaaacggcgccggatccgatgcagtccatactgttcctgtttatgcgtatgcggtgtgccgtctgaagacggatacggcgctggacggtgtgggcattgcgtttacactgggcagcggcaacgatttagtgtgcaaggcgattgaatatctgagcgaggagctggtgggccgggagatccatgagctgatggacgacttcggcacggtatttgcatccctgacagattccccctgcttccggtggctgggcccccataagggcgttgtgcatctggcgctttccagcattaccaacgcctgcttcgacctgtgggccaaggcggaggacgtgcctttgtggaagctgctcatcgatctcaagcccgagcagatcgtgcggtttatggacttccgctatgtggaggatctgatgaccaaggacgaggctctggagattctgcgggccggctggcagggccgggaggagcgcgagtccgtactgcgcacgggctaccgcggatatgacacgtccgtgggctggttcaactacccggacgatctggtggtggaaaacaccaagcgtgctctggaaaagggcttcaccgccatgaagctgaaggttggttccgcggatccggagcgggatattcgccgcgccgagctgatccggaagaccgccggcgacgccgccaccatcatggtggacgccaaccagcagtggacggttcacaaggctctgtatgtcattgacaagctgcgcagcatcaatccctactgggtggaagagcccacggatcccgatgatgtgctggcgcaccagactctgcggcgggcgttccatcccatccgcatcgccctgggcgagcatgttcccaataaagtcattttcaagaactatctgcaggccaacgccatggatatcaaccaggtggatgccgtccgggtcggcggtatttcggaattcattctcatcagcctgatgtccaagaaatatggcgtacccgtcattccccatgtgggagacatgggacagatccatcagcatatggtgctgttcaaccacattgcggtgggacatcccaatctgttcctggaggcgatcccgcatctgcgtcagtacttcaagtatccggtaatgctggaaaacggctactatgctgtgccgcaggttcccggaagtacctgtgactttgtggattga

SEQ ID NO: 2913 - DNA, 1257 bp, Oscillibacter sp.
atgcatcattatacattaaaatatatcgtttgttccgtcctgaccggcgcggcgctgctcttgagcagttgtgcccaggcctccgccacccagacgcaatcgctctccgcctcggagtccattccggtcacggtcatcgacaccagtacgcttttctcccagcaggatctggacggaagttacgacccttcacaggccgtcaccatttccctccagggcgacactgccgcctgcgacgatcccagcgtcaccattgacggctccacggttaccattacggcagaaggcgtctatctgctctcaggaacactgaatgacgggcagattcagattgatgcgccggactccgcccaggtacagctggtgctcaacggggtggatattaccagcgcagactccgcggccatctacgcattggaggccgatcatgtctacctcaccctggctgacggatcggaaaacaccctgaccaatggcggaacgtacgtccccatcgacgaaaacaatctggactccgtcatcttttccaaaaccgatctgaccctcaacggaagcggatccctcaccgtctgcgccgaggcaggacacggaattgtttccaaggatgatctcatcataaccggagggacttacaccattgaagccgccagtcatggtctgaccggcaaagacacattctgtattgccgacggaacctttaccatcacttccggcaaggacggcctccacgcagaaaacacggaggattccactctgggctctctgtatatcaccggcggaaccttcaccatagatgcccagggcgatgccgtaagcgccagcggcgcactgcagatcgacgccggaacgtttgatttgtataccggcggcggcagcgccgccgtctccatgtcctctgacaccgcgtccgctccggaccgtacccccggctcagataccggccggcgtggcgctcctcccgattcgcagggaacccctccggattccgacacacaggcaagcgatacggcagagagcacggtctccggttcagaagacagcgaaaccaccgactccatcagccaaaaggggctgaaaagtgacggcactctggtcattttggacggcagtttcaccgtggacaccgcagacgatgcgctccatgccggcggcgatctggccattgcttccggcgagtttacgctcagcagcggcgatgatgccattcactccgatgccgcaatcaccattctggacggcacctataccattccggta

SEQ ID NO: 2914 - DNA, 963 bp, Oscillibacter sp.
atgagtgtaaaatcctctttgagtgtgaaaaaatgggccggaaaaaacccctggatttggcctctgtttggtgcggtggctttgtggctggccatgggcctgattaccggcggcttgaaagttgatgtactggtcaccaatctgacactgatgagctatctggtctttttgagcctgggccaaaccgttgtcatcacaggcggagatggcgccatcgacctctccattcaatacaccgttgcgctcgctgcctatcttgcgtccctgctctgcgtctccatcggactgctgccgggattgctcatcacactgctggcgtgcgcgtgcgtgggcattgtaaacgggtttgtaaatctgtacatcaaggtcccgcccatgattaccactttggctgtgggctatattgtctattcctgcgtcctgaaactggcagccaagaacaccggcgtcccccatgagagcatcttgtggttcgcccaaaaggcccgtgtaggcagtctttctcccgttgtgttcgttgcgcttttggccgttgcgtttatgttcgtcttaatgtatcatacatcatatgggagaaaactccatgccgttggtcaaaaccgcaaggcggcccagctggctggtgtacgggtcacccccatcatcctgggatcctttgtcatcagctccctgctggccggtatttgcggcatcatgctgggcggttatttcggcggcgcattccaggatatgggtatttcctacatgcttacctccatttccgccaccgtaatcggcggaaccagtgccgcaggcggcaaatccagtgtggcaggctctgtatgcggagccttgatgctcaccatgctggtctctttcctgaacgtttcccgtcttcccgccgccacgcaggaactgatccaaggcgtacttctggtcacaattctggtcgtatccgttcccaaaaaacaagtgaatatttaa

SEQ ID NO: 2915 - DNA, 1026 bp, Oscillibacter sp.
atgaaaaaaagactgatcgcgatgatgctttcctccatcctgctactgtctcttgcagcgtgcgggcagacctccgataataccccggctggtgacgagggaagtgaagagggcggcacgattgtcctcaaatgcggacatgtgctggccgaagacagccattttgactttggcgtggataaatttgccgagctggtaaatgagaagtccaacggtaccattcagattgaagtccacactgacggcaccctgggacaagagcgcgagatgatggaatccctgcagctgggcaatttggatctggcactggtttccacggcgcccatcagcaacttctatcccaagatgtcggtgctggatatgccgtacctctttgactccaaggaacatgcgtatgccgttttggatggtgaaatcggaacgcagctgtttgaggagctgaagaaccagggcatggtgggtcttgcctatatggaaaacggtttccgcaacatcttttccaccaaggagattcggacgcccagcgacctgcagggcaccaagatccggatcatggaaaatgagatccagaccgccacgttcagcgagctgggagcaatcgtcaccaacatggcatccggagaagtgtataccggactgcagcagggcacgattgatgctgcggaaaacgccatctgcgcatactacagcagtgcatattatgaggtctgcaaagagctgagcctgacggagcacttctatggcgccacggcccttctgatgagcagtgctgtttatgactccttgacggaagagcagcagaacatcctgaaggaagcggctgcggaagcacgggatctgcagcgtgcagatgtggcggaacgggaatccaagtacctgacggagctgcaggaagaggatggcgttacggttcatacggacatcgacaaagaggccttcaagtccattacggaccagatttacgcacagttctatgacattgttcctgaagatctgattgaatccatccgcaactgcgcttattaa

SEQ ID NO: 2916 - DNA, 876 bp, Oscillibacter sp.
atgaacaagatcatttcacgccaggcggcggccgagctggtaaacgatcatgacaccgttgtagtctgcggatgtgagaatcttttgcttccggaccgcatcctttccgccctggaagaacggtacatatccaccggccatccatgcggcctgacggatattcaccctgtcatctacggaatgggcgagcattgcggactggagcactttgcacacgaggggtttctcagccgctccatcggcagtggtttcagttatctgaaaagctcccgcatgagccagctggtccgcgaaaacaagctggaggcctatgtggctcccatgggaaccatctaccgcatgatccaaaacatctcctgcggggagccctacaccctgaccgatgtcggtctgcacacctttgtggatccccgccagggcggcggccgattcaacgccaggacaacaaaagatatcgtttccctgatcgagctgggcggccgccagatgctctgctatcccaaccccagtattgatgtggccatcatccgcgcccacacttccgacgaaaacgggaacctggctctggagcaggagcctgtaagcctgggaatctattccatggcggtggcggccaaagcctgcggcgggaaagtcatcgcccaggtaaaccgaatcgtcgccaacgactccattccccccaagcggatcgtggtccccggcatttttgtcgatgccgtggttttggaagaagatgtcccgctatccggcggagccctgaatttcgccctttccggagaaaatcggatgccgctgggaagactggaaaatctccctctggacattcggaaagtcattctccgccgggccgccatggaaattggaactccgcccaaa

SEQ ID NO: 2917 - DNA, 765 bp, Oscillibacter sp.
aatatgacccgccccaccaaggagtttgtgggattggaaaactatatttccgtatttactgaccctgcatttgggaaaatcatgggcaatacgggactgtatattttgctgctgctggtatttgactttgccgcaccgtatgtcttttcattcatcctgtcctttgtggtaaaaaaaggaaagaacttctacaaaagcgccatttttctgcccagcgtcatctccctggtggtgggaaccatgattttcgtgtggattctcaaccccatttccgggccggtggccacagtggccaaggcactgggattgacggttcccatctggagcaacacccagggtctggtcatcgtggtgctgagcatcatgaccagctggaagatctttggctataacttcattgtggtgatggccggtgtgtccagcgtgcccatggaggtcgtggaggcggcccgtctggacaacattcccacctggcggatctttttgaacatcgtggtgcccatgagcagctccaccggcatctatgtgctgattttgtccattgtcaccggcatgcagcagattttcacccccatcaacatggtgaccaagggcgggccggacaatgccagcaccaacctcatttacgcggtgtatgaccaggcctttggattcttcaaaaccggtacggcctccgcatatgccattttgatgatgctgctgttcggctttttgctgtttttggagttcaagttcgtggaaaagagtgtgtactatgaaaactaa

SEQ ID NO: 2918 - DNA, 1044 bp, Oscillibacter sp.
atgaaaaaggtccttgcgatgctcatgacattcgtcatggtcctgtcccttaccgcctgcggcggctcgagcgattctacttctgattcctctgacagcacctccgataccccttctgattccagcgagacctatacgctcaagtttggccatgaccagcccgaggacaactacttcaacgtagctgccgaaaagtttgccgaactgcttcacgaaagatctgacggccgtatcaccgtggaagtctatccggccgctcagctgggcagcgaagcgacgatgctggagtccttgtccatgggtacactggacttccagatttcttcttcctccaacgccgccgtctatgttccggaactggccgccatgtcctgcagctacctgttcaacgatctggatcatctgacgcgggtggcatatgacgaggaattccagcagtactggcgtgatctggtggcggaaggcaacaacggctgccagctgatgagcctgttccccgccacgccgcgccacctgtacaccacgttccccgtggacaatctggccgctttgaaggggcgcaaaatccgcgtcatgtccgcccccattgaatccaccgtgtggggcgccctgggcgccaagcccaccaccgtcaacttcggtgaagtttacaccgctctgcagaccgacctggtggaaggcgcagaaaacagcatttcctcctactactccgccaagcattacgaagtggctccgtatctgaatctcacctatcatcagtatgccatcctggagatgtgggtatctgatgccgtaaaggataagctgcccgccgatctctatgagctgatcatccccacggcggtcgatgctgccaaggccggtctggaatatgccaacgatgtggaaaacagcctggtcgaagagatggttgccaacaatggtgtaaccgttgtggagcctgacatcagcgagtttaaggaagtcatcctgcccatccaggacgaaaacgccaaggagctcggctgcgagtgggtgctcgactttatccgggaacacgcctga

SEQ ID NO: 2919 - DNA, 1047 bp, Oscillibacter sp.
atgaagcgggctaaaaagctgtatattctgctgggcattctggtggcagtctgcgctgttacattcggtgtcagccgctatcagacccgacaggaagaaatcaaaaacagcggcgaggtcattctggaagtccccaccgattctgtggaatccctttcctgggacgtagacgaccgctccttctcgttccacaaggagacagccgaagaggatacggattcggaaagcatctggatctatgatgaagacgatgcatttccggtggataagaacaaaatcaacagtctcctctcctgctttgagtccctcagcgccgcctttgtcattgaaaatccggaggatctggggcagtatgggctgaccgatcctacctgcaccatcgacttctccgacggcgaaacctcttacacggtcttgctgggcgattacagccccatggactcccagcgttatgtctccatcggcgacggcaacgtctatctggtggaagatgatcccatggaggagtttgacgttgagctgagcaatatgctggatgatgacgacatcccctatctggaagaagaaggcacaaccacctccatccgcttctccggggatatcaactatgaaatcacctatgaggcagacagtgccaatacctatcgggaagaagacgtctatttcactgagcaaaacggccgtcaggtcccgctggattccacacgggtgagtgactatctccatgaagtcagcttcctgttccccgatgaatatgtgacctacaaggccaccgatgaggatttggccgactgcggactggataacccccagctggtcatcgaggcagactacaatacggaggatgatgacggaaacaccgtctccaagaccttcaccatcagcatcagccgtgaccctgccgagctggccaaagcacaggacgacgcagagaaaacgaacagctccgataccgaaaccacttccgaagaggaagaggacgcagaggctgaggacattaccgcttatatgcggatcggcgattccaagattatctatcggctctcc

SEQ ID NO: 2920 - DNA, 1371 bp, Oscillibacter sp.
gagccggaaaaacagggaaagactcccgatgcctttgaagcccagatggaagtgctgcgctttttaagtgagagcacagacgactatctgttttcctgggagtttccggaggaccgaatctattttgccggtccggtttggaaacggtatgccattatggaccccggccagtcggcctgctctttgcaggactggtgcagcgtggtctatgaaaaggatctgcctgccctgcaggaagaattcgagctgatccgccagggaaagaagaccgagcacaacatggaataccgtctggtggaccgggagggcaaccgggtatggatcagctgccgggggcggtgccagatcgaccgggagagctgtccggtccgtatgatcggccgtatttcagatactgccctggcgggaaaggtggatatgctcaccggagccttcaatgccggcaagctgacggaggatatcgcgggaattctccaggagggatcgccgtgctttttgctgctgctgggagtggacaatctgcggaatatcaatatccgccatggacgggactatggaaactacctgctgcagttggtggcggatactctggagaaatgcctggataccggcctgcggatctaccggctcaacggcgactgctttgcagtgaatctgcctgcggccagccggcgggaagtggagcggttttatgagtgcgtgcgcgacgccctgcaggatacctgtacggtgtccggcggtgccgtggcctatcattaccaccccaacgaggatgccagttccatctaccagtacgcggaggaggctctggacaaggccaagcggatggggaagaacaccctagctttcttttcccagaaagactacgaggaaaagctctgcaccattgagctccaggaggagatccggcagagcattctggacgggttccggggattttccgtatgttatcagccccagctgcgctcccggagctatgacctgtttggcgtggaggcactgctgcgcttccgctccatcacccggggagaggtaagccccgcggagttcattcccattctggagcagaccggcatgatctgccaggtgggactctgggtgctgaagacggctttggaccaatgccggcagtggcgcgagcacattcccggaatgcatatcagcgtcaacatctcctatgtgcagctggaccagaagaatacggcccagaaagtgctggatgttctggaagagagcgggctgccgggagaggcgctgactttggaagttaccgagagcatgcagctgcaggactactcccggttcaacaagattttctaccggtggaagcaggcgggcatcggaatttccgtagacgacttcggaaccgga

SEQ ID NO: 2921 - DNA, 1092 bp, Oscillibacter sp.
atgaaaattgcagtctatgccatctgcaaaaacgaggaatcctttgcccgccggtggatggagtccatgtctgaggcggacgaagtattcgtactggatacaggctctacagaccgaacagccgatcttctccaagagctcggtgccaaagttacaaaggactccattatcccctggcggtttgacactgcgcgaaatcgttccttggatctggttcctatggacacggatatctgtgtatgtacagatttggatgaggtctttcatcccggttggcggaaactgctggaatccgcctggcagccggaaaccgggcaggcctcgtatcgctatacctggtccttcaacccagatggttccgaaggcgtggtattctggtgccagaaaattcacgccagaaaaaactaccggtggattcatcccgttcatgaagtactgacttgggcaggccccggtactgcgaaaccgattttgaccatagacggcatccaattggatcatcatcccgaccccaagaagtcccggggacaatatctgccgctgctggagttgtctgtaaaagaagcgcccgatgatgaccgaaatgttcactacctgggacgtgaatattttttctaccatcgctgggaggagtgtattgcaacacttatgcatcatttatccatgccctctgcgacatggcaggatgaacgcagtgcctctatgcgatacatcgccaagtcttacctgatgttgggagatcctcagcaagcccgaaactggtattttcgtgccattgccgaagcccctcatttacgggaaccctatatggattttgcccagctcctttatgaaacacaagactgggacggagtactctattttacagaatgcgcgctctccatcacacagcgaccccgcagctatatctgtgaagccgctccctggggaagtctgccgcacgatctgcgctgtatggctttttaccacaccggacgtccgcttcaggccctggaagaagcccgtcttgccctggcgctggaacctgaaaattcccggctgcaaggaaatataactttactggaacaaatcaatagcagtcactcttcgtaa

SEQ ID NO: 2922 - DNA, 729 bp, Oscillibacter sp.
atgctgtctgccgcattactgctgtttgccaatactctgctgttttctctgcgcctttccggcggaggatcctttcccaaacctcttaccgccggtgaggaacgggagtatctgcaccgctgtgctttgggagatacacaagcccgcaacatcctcattgagcggaatttgcgtctggttgcccacattgtcaagaagtattacacgcaaaattctgatcaggaagacttaatttccatcggaaccatcggtttgatcaaaggaatctccagttttgatgccagcaagggagcccggttggccacctatgcagcccggtgcattgaaaatgaaattctcatgtacttccgcagtcaaaagaagctgcaaagcgaagtctccctatccgactccattgaaactgacaaggacggcaatgccttgcagctgatggatgtggtcggcgtagatgacaccatgctggaagacctccatgaccgggacagtgcactgcgtgtccgcacattggtgcaggaacgcctcaatccccgggaggcagaaatcatccgccttcgttacggtctgggcggcacagttccgctgacgcagcgcgaagtggcatcttcgtttggtatctcccgttcctatgtatcccgcattgaaaaacgggcgctggagaagctgcgtactgccctggaatcccccgctgttccacaagcgcggcacagcaaaaaaaaggctgacgtttaa

SEQ ID NO: 2923 - DNA, 825 bp, Oscillibacter sp.
ctcaacgatgtgtccaccaccgcgcccatcatcctgcggggacccatcgaacagctctgtgagcaggccaagaaaatcgggtatgacggcctggagatccagctggccaaccccctgcagtatgactggaagcacatcaaggaggtgtgcggggcgtacggtctggacctcatcacctttgccaccggccgggagctgggtgaaaacggcctgtgcctgctctccgacgatgcgtcggtgcgccgggcagccattgaccggctcaaggaacacattgactgcgcgcaggttgcgggctgtcaggtgattgtgggctccatgcgcaagcatgtgccggactggagccagagcgacaagtatctgggctatcaccgggacgccatcgtggagctggcggactacgccaaggacaagggcgtgcggatctgggtggagaacatcctgagctacatcagcaacttcctcaacaccatgcgccaggtgcaggactttgtggcatccctgccctgcgacaatgtgggcgtccatctggatacttacagcatgaacatggaggacaacgacatccccggctcttaccggtactgcgccaagaacctggagtatgtgcacttctccgacacggcccggctgtatcccggcggcggcaatgtggacttcaagacccacatgcgctgcctcaaggagatcggctatcagggctatatcaccaccgagtgcgtgcccctgcccacggcctatgactgtgccgatctgggattgaagtacatgaaggccatggagcagattgtggatattgaacggggcgcctcccgctttgcctga

SEQ ID NO: 2924 - DNA, 978 bp, Oscillibacter sp.
tttcctgcggattccgcaggagctaatatcatcattttttgggaggacagtatgaaaaacgtgaaaagactcttggcagcactgctggcgaccctcacgctggtcggcctgaccgcctgcggcggcagcaagcagcaggaagacaccaccgcgtccgatgacagcggtgatgcaaccagcaccgaagaaacctacggcgagggctacgtgctccgcgtcggcatgaactgcagtgcagcccccttcggctggactcaggacgatgactccaacggtgcatggcccatcgacggcaccaatcagtatgtctgcggctacgacgtgcagattgcccgcctgatctgcgatacctacggctgggacctcaagaccgactgggacggcctgatccccggcgttgtctccggcaagctggactgctgcatctccaccctgggcgtgactgaggagcgcctccagtccgtggacttctccgattactactggaataacggctgcatcatggtcgtgcggaaggacagcccctatgtcaacgccacctctctggaggactttgacggcgcgaagatcaccacccagatcgctaccatttgggagcctctggtgcagcagatccccaacgtgcaggctgagccctgcctgagcggtctgcccgagctgtttgtcgcagtcagctccggcaaggtcgacggcatcatcaccggtctgtccgaggcccagtccgcctgcctgtccaaccccgacctgacctgggtcaccttcgaggacggcaagggctttgacgtggagctctccgctctgtgcgccggtatccccattgcaaagggcaacaccgagctcaaggacaagatcaacgccgtcatcgccaccctggatcacgacacccagatggaaatgatgaccacggctctcaacgcccagcccctgagcgacggctccggcgaagcgctccaggccgaagaaaccaaggacatgtaa

SEQ ID NO: 2925 - DNA, 1224 bp, Oscillibacter sp.
ttggctcagaagaaccggtatatcaaatgggggctgaccgttttctgcgtggtggccgcgatcctgcttttttatgatacgctctttggccaccaggtcctccaaaaatttatcagacagttttccggggcggttcgccctgtgctttacggcgcgtttatggcatatttgctggtgccggtggtggatttctttgagcggcagttctgttccgtttcaagcgtaaaaaaggcggttcagaccggaaaggctgctatggcagtccgggcgctgagcatcctgctgacctgggtggtcatcggcgtgctgctgtatctgctggcgtcggtcctgctgcccgaactctataagagcgtcttgcagctggtatccaatgcggagacatattactggaccatcagcgactgggtccagcatttgctggagaccaatcccgctctggaaacctgggtggccgcccagatggacggcatctatgccgacatcagccactgggtgaaaaccgatatgctgccccaggcccagatcctgatgctggccctttccggcggtgtattcagcgtagtgggctttttcggggatctgctggtgggcatcatcgtctcggtgtatttcctggcgaccaaggagcgctgctgtgcctatgccaagaaggtcatttacggcctgttttccctggagaatgtcaagtggatcctgcggggagcaggcaaggtggaccgcattttctccggctttgtccgggggaaattgctggactctttgattattggtattttgtgcttctttgggtgcagtattctggatttcccctacacgccgctggtatccgttaccgtgggcgtcaccaatgtgattcccttcttcggccccttcctgggcgccattcccagcaccttcctgattctgctggtctcgcccatcaaagcgctttattttgtgatcttcattctggccctgcagcagctcgacggcaatgtgatcggccccaagatcctgggagacaagacgggcctttccagcctgtgggtgattgtggcgattctggtgggcggcagcttcttcgggatcccgggtatgtttttcggcgtgccggtgtgtgcctgtctgtacagcgcggccaacttcctggtggagacccggctgcacgccaaacacctgccggtggacgcggagtcctatggcccggaaaagcatccggcgcaggagcaggagccgaaatga

SEQ ID NO: 2926 - DNA, 2196 bp, Unknown
  Description of Unknown: Clostridiales sequence
atgtcaaaaggctccttctgggttaactgcagagaaaatctgaagcgcagaagctggaccgtgcttctgtgcgccattgcgctgttcctcgccctgccggtcaggctggcgatgattctttccgtacagagccggcggattgcccgggatccttcctggattgcggaatggacgcagggagagctgctgggaaacagatttatgcaggagctgtcaaacgattattttctgtttctgatttttgctcttgcgattctgctggctgtgcagggctttgcctgggtggacagcagaagaaaactggatctgtatctgagtgttcccgtgtccgccagaagacgatatgtggtcatttacctgaacggagcggcggtatttgcagtctgttatctcgcagcactgattctggccctggtaacgggggcggtgatgggaggtgtatccggcggggtgcttctgtatgctctgatcacatatctggggaatcttctctttttcatggtctgctatcatatgacgctggcggcggtactgctgacgggaaatgtgctggtttctctgcttgccgcttttgtccttttcttttatgaatacgtgctccgctggcttattgacgggatgagaagctccttctttgtcacctactgcgggctcagcaatgtggcagagaacgcatttacctctccggtcatctcctggatatcgggaagcggcggactgctggaatattttctgggatatggcggccgttacctggcggattacggaaggatgcttcttctcatggtggttcaggtgatcgtttacggactggtggactggttcctgtaccggaagagaagagcggaggcggcgggaagctcactggcctttccacggcttcggactccggtgaagcttctgctgatggttccggtcactctgctttccggcatgtggttctggcagctggcggaccggagcattccctttgccatcatcggtatggtcatcggcctttttatcagccatggcctgctgcagatcctggatgaattcgatgtaagaagcattctgaaggcaaaatggcacctgcctgtggccggagtggcggcggcggttattttcgcggcctttgccctggacctgaccggctatgacacctatattccggcagcggaaaaaatcgaaagcgtggggattgcctttcgaagtgacaactattatctgggcttttatgaaaatctgttcggacgggacatgtaccatgaggacccggaaaagtacatgctgaaggccatggaatcggaggatgaggacaccatcgcggcggtgagagctctggcggaaagggctatggaggacatggaaaactccggcaggcaggggcctgacgcatattccatctccgacggaagaacccctgtttcgatccgatatactctgatggacggaaggcgggtttaccggacaatatgggccggagtagaggacagcgcagaggagctggatgtgattttttcagatgcggacttccagactgccagatatcagatctgtgatcccgcttttattgaaaaaagcggtgaaatgaggatttcctatggaaacggactgaaccgggtttcctgtctgggtgatgcggcagagcttctggaggcctatgggaaggatctttcgaagtacagctacagcctcatgctgaacagccttccggttggaaagctgagttttgtctggaacccgtccggcatggtggaccgggaatatacctgggagtatcctgtttatgaggaatttacggaaacggtggaacttctgcgggagcagggagtatacatggaacggacagaggaaggaggcgtcctttctgcagatcagctggtgagcgtgagcattacctgctacaatctggaagaggagaatgtggaatacagtgctgacggatccagagcggttgtttattccgccgaccgtgaaatcagccggacctatacggaacaggaccggatcagacagattctgcccgctctttatccggacagtctgacggatgtggccggcggcggtatcacaggaagactctggaatgataactatggggtctccgttgtgttccagccggatgtgcatctctcagaagaatatctttacttcacggtgctggacgacagacttccggacttcgtgacagaggaaacccgctatcaggaatga

SEQ ID NO: 2927 - DNA, 2931 bp, Unknown
  Description of Unknown: Clostridiales sequence
atggaggcagatatgaagctggaagaactgacaagctatcgaattcttgaaatgaggcggattgaggatctgaattccttaagctgcctgctggagcataagaagagcggggcaaggatcgcccttttgtccaatgaggatgaaaacaaggtgttttatatcggattccgcacaccgccgaagaacagcactggcgtcgcccacatcatcgaacattccgtgctggagggaagcagggatttcccggtgaaggatcccttcatcgagctggcgaagggcagcctgaatacctttttaaatgccatgacctatccggataaaaccgtatatccgattgcgagctgcaacgacacggatttccagaacctgatgcacgtctatctggacgcggtgttctatcccaatatttataaagaaaaaaagatatttgagcaggaaggctggcattacgagctggagaacccggaggatgcgctcaccatcaacggcgtggtttacaatgaaatgaagggcgctttttcctctccggacgatgtgctggaacgcaaaatttccgagaccctgtatcccgatacgccctatgccatggaatccggcggcgatccggatgtgatcccggagctgacctatgaggaattcctaaatttccaccggaaattctatcatccttccaacagctatatttatctgtacggaaatatggatatggcggaaaagctggactatctggaccgggaatatctgtcccactttgaccggatcgaagtggattcggaaatccgtgtccagcctccgtttacggagaaaaaagaggctgccgcccagtatcccatcacggacagcgagccggaacaggacaacacttatctgtcctataacattgtggtgggggacaacctggacagagagcgttacatcgccttccaggtgcttgactatgtcctctgcagcgcgccgggcgcgcccttaaagcaggcactgctggataaaaagatcggaaaggacgtttacagctactatgaaaacggtctgcgccagccctatttcagcatcatcgcaaagaacgcgaacctttccgacagggaagaattcgtgaatacgattgaagagacgctttcccgcatcgtacgggatggaatcgataaaaaagcgctgaaggccggactgaattattatgagttccgttaccgggaagcggatttcggctcctggccggcaggactgatgtatggtctgcaggtgatggacagctggctgtacgacgacaggaagcccttcatccatatcgaagcgggggatacctacagaagtctgcgcgaaaaggcggatacggactattttgaaaagctgatcagcacctatatgattgacaacacacacaagagcgtgcttaccctggagccgaagaagggactttccagagagcatgacgagctgctgaagcagaagctggcagattataaggcaggattgtcggcagaagagctcgagagcatcatccgggaaaccgaagcgctgcgggaatatcaggaaacgccggatacaaaggaggcgcttgcctgcatcccccttctgaagagagaggacatccggaaggaggcggagcctctggtcaatgagatcggatctttaagcggcagcacggtgatgtaccacgagctgttcaccaaccacatcagctatttccgcttcctgttcgatctgaaggcggtgccggaggagctgttttcctatatcggcatcctgaaggcggtgctgggctatgtggataccgaaaaccattcctatgacgagctgttccatgagatcaacatggagacgggcggcatcacagcggtaaccaacctgtttaccaacgcgaagaacctggaggaatgcagggtaacctttgagatcaaggtgaaaactctggagaataacctgcctaaagcggtggatctggcgcaggaaatcatgcttcattcttgctttgacgatgacaagcggctctatgagattctggcggagctgaagtcccatctgcagtccgcgctgatttccgccggtcacagcgtggcggcaggacgcgccatgtcctatttctccagacctgcggccattcaggaacgtttaagcggcatgcccttttaccgtctggtggatgatctggagaagaactttgaaagcagaaaggatgatctgaaggaaaagctgaaccgtcttgtacacagcattttccgcccggaaaacctgctgcttgactatatcggaaccagagatcattatgagcaatttcttcctctggcagaaggcgtgaaggcctcccttttcacagaagccacacagggcgagcccttcaccattctgcctgaaaagagaaacgaaggcttcctgtccgcttctcaggtgcagtatgtctgccgggccggaaacttcatcagcaaaggcctttcctataccggcgcactgcgcgtgctgaaggtgctgatgagctacgaatatctgtggcaggaggtccgcgtcaagggcggcgcctacggctgcatgtgctcctttgggaaaagcggagacagctacttcgtttcctaccgggatcccaatctgaagggaacggtggaggtttatgaaaaggctgcggacttcgtggaagcctttgacggggatgagcgcaccatgactcagtacatcatcggcgctgtcagcgaaatggacacgcccttaaatcctgcggcaaagggcctgcgttccatgagcgcctggctgaccaatcagtcgcttgccgatctgcagaaggaaagggatgaggtgctttccgccacgcaggaggacatccgcgccctggcagcccatatacgggcattcatgaaagatgactgcctctgtgtggtgggaaatgaggaaaagctcagggaagaggaggatatgttcctgcatctggaaaatctgtattaa

SEQ ID NO: 2928 - DNA, 1029 bp, Unknown
  Description of Unknown: Clostridiales sequence
atgagttttaagtttatcagaaagcttcccaccccggaagaaatcagaagagattatgctgttccggagcggatcgtccggctgaaggaggaacgggatcaggaaatcagggatgtattcaccggaaaaagcaacaaatttcttgttatcatcggcccctgctccgccgacaatgaggacgcggtctgcgattacgtttccagactcgcccgcgtcaacgaaaaggtaaaggacaggctgatcctgattcccagagtttataccaacaaaccccgtaccaccggagacggctacaaaggactcatccatcagccggatccggaaaaaaagccggattttctgcagggtctcatcgccatgcgtaaaatgcatatccatacggtggaggtgtccggcctgacctgcgcggacgagatgctctatccggaaaactggagatatgtctccgatattctttcctatgttgccatcggcgcccgttccgtggaagaccagcagcaccgcctcgcgaccagcggctttgatgttcccgccgggatgaaaaatcccaccagcggagatttttccgtcatgctcaattccgtctatgccgctcagcatccccattccttcatttaccggggctgggaggtcagcaccaccgggaacgacctggcgcatacggttcttcgcggcgccaccaacaagcacggcagaaatatccccaactatcactatgaggatctgaacctgcttctgaccctgtacaacgaaagagatctgaagaatccggcgtgcatcatcgatgccaaccacagcaattcggacaagcagcacaaacagcagatccgtatcgttaaggaggtcatgcacagccggaagctgaatcatgacatccacaccctggtcaagggcgtcatgattgaaagctatattgaagagggctgccagaaggtgggcggcggtgtttacggaaaatccatcaccgatccctgcctgtcctgggaggattcggaacgtctgatctacgatatcgcggaatacgaataa

SEQ ID NO: 2929 - DNA, 1311 bp, Unknown
  Description of Unknown: Clostridiales sequence
atgtgggcatatgagagcgtattttatcagatctatccgctgggcttctgtggagcgccgtttgaaaatgatggtgtggaaaagccccggattctgaaggtgaaggagtggattccgcatataaaggggatcggcgcggacgcgatttacttttctccggtgtttgaatccgatactcacggttataatacaagagatttcagaaaaattgactgcaggctgggaagcaaccgggattttgcagaggtgtgcaacagtctgcatgaggcgggaatccgcgtggttctggacggggtgttcaaccatgtgggaagaggcttctgggccttccaggacgtgctgaagaaccgggagaattctccttatctgaactggttccatatcaatctgggcggcaattccaactataatgacggcctgtggtatgagggctgggagggaaattatgacctggtgaagctgaatctgaaaaatgaagaggttgtgaatcacattctggaaagcgtccgtttctgggtggagaacttcgatatcgacggtctgcgtctggatgttgcctatctgctggatcatgactttgtgcgcaggctccgcagcttctgcgacgggctgaagaaggactttttcctggtgggagagatcctgcatggcgactataagacgctggtgaacgatcagatgctgcattcctgcaccaactatgaatgctataagggactgtattccagcttcaacagcatgaatctgttcgagatcaatcattcactgatgaggcagttcgggccggaaaactggactctgtacaaggggctgcatctgatgacctttgtggacaaccatgatgtgacgagggttgcgagcatcctgaccaatgaaaagcatcttccgctgatctatgcgctggcgtttggcatgcccggcattccatgtatctattatggaagcgagtggggagcggaagggaaaaagagcgacggagatccggctttgaggccctgctttgaggtgccggtggaaaatgaactgacggaatttatcggaaagctttccgcggcgaaaaagggttccaaagcgttgaattatggaagcttccgctcagtggtgctgacgaacagacagtgcattttcgaacgtaagacggagggcgagagggttcttgtcgccatcaatgcggacagcgagccttatactgcgcattttgacgccggctgcggcatggctgtggatctgattaccggcagcaggcatgactttggaggaggaagccagctgccgccttacagcgcgtatttctggcgttgcgaagcataa

SEQ ID NO: 2930 - DNA, 1881 bp, Unknown
  Description of Unknown: Clostridiales sequence
atggccgcgtacagcgccggttttcaggaagtgagaggaaaatctatgaagcagaaacgagaagatgtgagaaacgttgcgatcatcgcccatgttgaccacggaaagaccacgctggtggatgagcttttgaagcagagcggcgtattccgcgccaatcaggaggttgtggaacgtgtcatggattccaacgccatcgagcgtgaacgcggcatcaccatcctttccaagaacacggcaatcacctataaggacgtaaaaatcaacatcgtagacactcccggccacgcagatttcggcggcgaggtggagcgtgttctgaagatggtaaacggcgtcatccttgtggtggatgcctttgaaggccccatgccccagaccaaattcgttctgaggaaggcgctggagctgcagcttcccgtcatcgtctgcgtcaataaaatcgaccgtccggaggcccgccccaatgcggtggtggacgaggtgctggagctgttcatggatctggacgcaagcgacgaacagctggactgccccttcgtattcgcttctgccaagaacggaagcgctactctgcagctgaccgttaagaataaagatatgaagcctctgctggataccattctggactatatccccgccccggaaggcgatccggacgccggaacacaggtgctcatcagcaccatcgattacaatgaatatgtgggacggatcggtgtcggaaaggtggataacggcgtcatttcagaaggacaggacgtggtgatcgtcaatcatcatgagccggacaagcagaaacgcgtccgcatcagccgcctctatgaatttgacgggctgaacaaggtagaggtgaagcaggcttccatcggctccatcgtggccatctccggcattgcggatatccatatcggagataccctctgttccccggaaaatccggttccgatcccgttccagaagatttccgaacccaccatcgccatggatttcatcgtgaacgattctccctttgccggacaggaaggaaagttcgtgaccagccgccacctcagagaccgtctgttccgggagctgaacacggacgtatccctgcgcgtggaggaaacggattccacggaaaccttcaaggtttccggccgcggcgagctgcacctgtccgtcctgattgaaaacatgcgccgcgagggctatgaattcgccgtcagcaaggcggaagttctgtacaaaacggatgaaaacggaaaacgtctggagcccatggagaccgcttatatcgatgtgccggaggaatacgcaggaaccgtcatcgaaaagctttcccagagaaagggcgagctcgtcaacatgagcgcgtcaaacggcggctacacccgcctggagttcaacattccgtcccgcggcctgatcggctaccgcggcgactttctgacggataccagaggaaacggcatcatgaacaccgctttcgctggctacgccccctacaagggcgatatccagtaccgcaagcagggctcgctcatcgcctatgaaaccggcgaatccgtcacctacggtctgtacaacgcccaggagcggggcactctgttcatcggtcccggcgaacgggtctatgcgggaatggtcatcggccagagcggacgaggcgaggatattgaggtaaacgtgtgcaagaaaaaacagctcaccaacacccgttcctccagcgccgacgaggcgctccgcctcacccctccccggatcctgagcctggagcaggcgcttgacttcatcgaaacggacgagctgcttgaggttacccccaagtccctgcgcatccggaaaaagattctggatcccacgaagcgtaagagggcgaatatgaatcggaataactga

SEQ ID NO: 2931 - DNA, 1233 bp, Unknown
  Description of Unknown: Clostridiales sequence
ttgtccctgcagattttgcagagacaggagtttttttatattcagaaaagttccttctttatcgaaaaaaatgttttgaaaaagaatgcggcatcgtcatgcagcagcctggtcagagaggagatatttatcatgagactggaaaactacgaaatgcatctgccaaactattccatcggagatcatatttatgacaaaatcgggccggtatgcgaatcctatggaagaaaggttcttgtgatcggcggcagaaaggcgcttgccgccgcatacgataagatcaaatcatatacggatcagacaaggcttgtgattatcggaaaggaaatttacggagagaactgtacctacgagacggtggaaaagctgcgcgcgatgccgctgtatcaggaagcagacatggtattcggcgtgggaggcggcaaggcgctggatacggtaaagtgtctgtgcatcacggatgataagccggttttttcctttcctaccattgcatccaactgtgctgcctgcacgtcggtctccatcatgtacaatgaggacgggacatttctgaagccgcatttttttgtcagaccggtcatgcacgcattcattgatacggagattattgcaaaggcgccggcccagtacatgtgggcgggaatcggtgatacctatgccaaatattatgaggccacgatttcttccaggggagagcggctggagcatttcacagcgcttggcacggcggtcagccggatgtgccgggatccgctgatcgactatggaaggaaggccatggaggaccacagaaaggggctctgtacctatgaggtggagcaggtcgttctggccatagttgtgacaacgggaatagcgtccattttcctgaccagagatttcacaccggattataacagtggtctggcccatgccgttttctacgcgctgacttcttatcctgtgattgaggagaggcatctgcacggagaggtggtggccttcggcgttttgctggcgcttctggcggacgaacagtatgaggaatttgaattaatttattccctgaaccgggatctgggacttcctgtttccctggaggaaattgaaattaccggggagcagtggaaggaatgtgaaaaacggattccggacatgtcggatgtggcgcattatccttaccgggtaacggaggagatgctggaaaaggccatgaggcagttgaaagagagggcgcagaaaaatgtctga

SEQ ID NO: 2932 - DNA, 1011 bp, Unknown
  Description of Unknown: Clostridiales sequence
atgcttcagcaaaagataacctgggccctggcggacgtgcagcgcattcagcagccgagaaaccattatggcgaacgtctttccaggatcggtcccggaaaggagacgatcttgaataccttagatcacctgagcactctggaagcggaatccatctacatcatgcgggaggttgccgcggagtgcgagaagcccgtcatgctttactccatcgggaaggacagctccgtcatgctgcaccttgccagaaaggctttctatccggagaatcctccatttccctttcttcacattgacaccacatggaaatttcacgagatgatcgagtttcgtgacgcaaccgcaaaaaaatacggtctgaatatgctggtgtacaccaatatggacggtgtacggcagggcatcaatcccttcgaccacggcgccgcctatacggacattatgaaaacccaggcgttgaaagcggcactgaagcagtatggctttacggcagcctttggcggcggcagacgggacgaggaaaaatccagagcgaaggagcggattttctccttccggagcgccgagcagacctgggatcccaaaaaccagcgtccggagatgtggaagctgtacaacaccaggatccacaagggcgagagcatccgtgtcttccccctctccaactggacggaggccgacatctggcagtacatcaaaagggaaaatatcgagatcgtctccctctactacgccagggagcgtccctgcatctaccgggacggcaacatcatcatggtggatgacgacaggctgaaactccgccccggcgaaaaaatcgagtacaagaaaatccgtttccgcaccctcggctgttatcccctcacaggaggcatggaatcggacgcggatacgctggataaaatcattgccgaaacgctgggcgccgtttactcggaacggaccagccgcgtgattgaccacgaagcggccggaagcatggagcgcagaaagagggaggggtatttctga

SEQ ID NO: 2933 - DNA, 2880 bp, Unknown
  Description of Unknown: Clostridiales sequence
atgacaacaaccctttctcagcgtttctctttccggaagctgcctgcggccgcgcgtcagaacgcggcctgcctgctctcctttctcatccctctcgccgtcatgtgcggcattttcatcatcaacggtgtgtacccgttcggggatgagagtttcatgcactccgatatgtatcatcagtatgtcccctttctttcagagatgcagaacaagctgaaaagcggggacagtctcttttattcctggaatgtggggataggctccaactttctcgcgctgtacggctattatatggcgagccccttcaactggctggttgttctggttcccgattcgctgctgatcgagttcatgacctggctggtggcccttaaaatcggtctgtgcggcttcaccttctgcttttatctgacccgccatttcaagacgaagagcttcgtgctggttcccttcgccattttttatgccctttccggctttctggcggcctacaactggaacgtgatgtggctggactgtattgttctgtttcctctgatcgcggtgggcctggaggccctggtaaatgaaggaaaatataagctctactgcatcagcctggcgttgtgcattctctccaactattatatttccatcatggtgtgcatcttcctggtgctgtatttcctgctgcagctcgtctgctcccggctgtccctgaaacgcatgggggccgcggccgtccggttcgctctcttttcccttcttgcaggaggactggcggccgtgcttctcattccggaatatgcagcgctccacctgaccgacttcagcgaattcaattttccggacacgctgactttctatttttcgttccttgacatgatcgcaagacactgcatgaacgtcaacgtggaaacaggtctggaccactggcccaatatctactgcggcgtggccgtcttcctgctggtgcctctgtatgtgacgaataccaaaatagctcttcgggaaaaggcggcgtacatcggacttctggcctttatgcttctgagcttttccacaaatatgctcaatttcatctggcacggtctgaactatcctgattccctgccctgcagacagtcctttctgtacatttttctgctccttaccctctgtgcaaaggcagttctgaacatccgcggctgctcgctgaaagcgctgggaggctgtttctgcctttcactcggctttgtgcttctgtttgaaaagctgatggcggatgaggaggcataccggacggaaaccttccttctgaccgctcttttcctgtgcctgtacggcgtattcctctatttctggcataatatatgccagcataatatatgccagcataatgtatgcctgcatacggacgagcgcaccaggcaggccgcttccgctgcaggcggctcccgtatcgggctgggccttctcgcagttctgacgctgacctccgttaccgtggaggcggccgtcaatacctacaccaccagctgctccgtcaccagcagaagcagctacctgaacaacctggacagctatcagacgctggttgaaaggaccagagaacgggatacggacttctatcggtttgaaaagaccagccgggtcaccaaaaatgacggtacgctggtgggctatcccacggcttccctgttctcctccacctccaacggacatgtgcaggatttttatgacaaaatgggcatgagcgacagcaaggtgttctactgctttgacggcgcgacgcctctgtcctcctctctgctcggcgtgcgttatgtgttctcccgctccgccaacgaggatcccgctctttataccctgatcgatcaggaaggggatatttatctgtatgagtgccgctacagcctgccgctcggcttcatggtgagcgcgggctccggcttctccgcttcggcgcagtcctccggcttttccggaaatgccgatacctcttccggtacggcaggaagtggaaacggcatgcagcagtccggcagctcttcctcttcctttgaatccgcttccgaggcttctcccctggatgagcttctcggcgatatcgatgataccaggacggatgcgctggaacgggctctggatttcgaaggggccactccctttgatacccagaaccgcatggtacaggctctcggtatagagaagaatctgttcacctccgtcggagcttttcaggaggaggacggtgcgactaccatcaccgccgatgtaagcggccattactatgcctatgtgggcgatacgggcgtaaatactctgaaaatggaatccgaggcgggaaacaaaaacttttctcaggtgaaatatcactatatctgtgatctgggctggcatgacgcaggggatgtaatttctctgacctctgacgacagcgacagcctgaatgtaaccgcctgccgcctgaatttcgatgtgatggatgaggtgatttccatcctcggtgaacagaccatgacggtggattcttacagctccacccagataaacggccacatcaacgtttcccgggctggagagctgattctcagtgtcgcatatgagcctggctggacgattctggttgacggcagagaggttcagcccggcctgtttgacgacaccttcatcagtctctcgctgacggaaggggagcataccattgaaatgcgctaccgtcccgccggactgatcatcggaatcatcgtaagcctgatctgccttgccgttttcgtggcgatcatccttctggaacgcaggaggcggaaaatgtccggcccgcaggtccctgaggaccaggcacagcagcatccgttccggcctcatctggagaatgaaaagcagaactccgccaatccggctgaaggaggcgcatga

SEQ ID NO: 2934 - DNA, 1062 bp, Unknown
  Description of Unknown: Clostridiales sequence
ggggatgaagaggcggtaagccgcgcgaatgtgtttctgcgcagcgccgagaggattttgatcaaagtcggatcttttcatgcggaaacctttgaagagctgtttcagggaacccttgcgcttccctgggaggaatacataccgaaggacgggaaattctgggtggcgaaggctgccagcgtgagaagtaagctgttcagcccctccgacattcagtccatcatgaaaaaggcgatggtggaacgcctgaagaaaacctaccacaccggctggtttgaggagagcggcgagagctttccgctccgcgtttttctgaaaaacgacgaagtgaccgtggggcttgataccacaggggaatccctgcataaaagaggctaccggaaactgacggccaaagcgcccatcgcggagaatctggccgcggccttaatcatgctcactccctggaagggagaccggattctggttgaccccttctgcggcagcggcacgattccaatcgaagccgccatgatggcggtgaatatggctccgggaatgaaccgggattttacggcttcctcctgggagcatctggtggcaaaacgaaactggtatgacgcggtggatgaggcggcggagctcattgacatgagcgtggataccgatattcagggatatgacattgatgacaaaatggtgtccattgccagagagaatgcgcgtctggcgggcgtagaaggaaaaattcattttcagagacgccccgtatctcagctgagccatccgaagaaatacggttttatcattaccaacccgccttacggggaacggctggaggagaaggcagcgctcccgaagctgtatcatgaactgggagagcgcttcgcagcgctggattcctggtccatgtatctgatcacagcctatgaaaacgctcagcaggacatcggaaggaaggcggataagaaccgcaaaatatataacggcatgatgaaaacccgattttaccagtatcaggggccaaagccgccgagaaggccgagggaaggcggagcatctgtcatgaaagaggaaaaatga

SEQ ID NO: 2935 - DNA, 3219 bp, Unknown
  Description of Unknown: Clostridiales sequence
atgaaagtcatgaatgcggagtggagggaccgcgttgatcactgggtcagaacgctgaaagaggatttttatgaacccctgggggaaatatcctgggaagcgtcacgcaccatggaacatttaagtccggaggaggccagggagctgccattcgttcctgtccagccgggattcgtctggggaaatacatgggaatactgctggtttcagggaagtgtgacgctcccggcaaaggcggaaggaaagcggatcgtgttgaacctggctccggacggagaatccaccctgtttgtgaacgggaagagcttcggaacctaccgcgctccctgggtcagcgagaagcatcattatgtggaagataatgtgctgacaagagaagggaaagcaggagagcggtttgatatcctgatggaaacctatgcgggtcattattatccggagacgccgaccggagggtgtgcaacgggaccggtgctcgaaggactttatcaggatccgctggaagagggaagaaggcgtaccctgggcgtgtgcaccttcggaatctggaacgaggacgcttatcagctttatatggacgtccagacccttctgggacttctggaggttgtggatctttcctcgctgcgtgcagcgaagattgcggaggcgctggagcagttcactctgaccgttgattttgagcaggacagggaagcgagacaggcttcctacagggaggcttctgcgcagctgcggccggtgatggaggcggtaaacggttccacccagccggtattctatgccatcggaaacgcccatctggatcttgcctggctgtggcccatggcggagacgcacaggaaaacctcccgcacctttgccgctcagctgcggctgctggaggaatatccggaatataaattcctgcagagccagcctgcttcctatgaaatgtgcagaaaatattatcccgagctgtttgaacggatccgcgatgccatcggaaaggggcagtggattgcggaaggcgccatgtgggtggagccggataccaatatggcttccggagaggccctgatccggcagctcgtccatggaaaacgctactacaaagatgtgctcggaacggacagcgtgattctctggctgcccgatacctttggctataccgccgcgcttccccagattctgcagggctgcggtgtgaaatacctggtgacacagaagattttctggtcgtacaatgacggggaaccgttcccttatcactactttacctggaggggaatggacggctccgagataacctccttcctgcccaccagttatacctaccgcacggatccgaaggagatcaacgatgtgtggaagaaccgtgtacaggccagggatctggacgcctttctgtttcccttcggttatggagacggaggcggcggaccggccagagaccatgtggaatatgcgctcaggcagaaggatatcgagggcggcgtgaaggtgaagatggccggaccgctggaattctttgaagatatggagaagctgggcggaccgaagaatacctatgtgggcgaactgtatttcagcgcgcacagaggcacttattcctctcaggcggatattaagaagaacaacagaaagagcgagctcatgcttcgtgaaatggagatgtgggcctgtgcggcttccctgaggggctggacctatcccatcgaacaggcggacggactctggaagacgctgcttctgcatcagttccatgatatccttccaggctcctccatcgccagagtttatgtggaggccaacgcagcccacgaaaagctgcaggcggaagcggcgggaatcacggcggatgcagcagcagctctgatggagaaaaaagagggcgttagcgtattcaactctctgagttttgacagaaaagctctcataacccttccggaggaatatgcggacggcgcagccaaagcggacggaaccgtcgttccggttcagagaacctctgagggcgtgaaggcgctgctatcccttccttcctgcggcgcggtgtccctgtatccgaaggcgggaaaaatgccggcggcagaaacatcggaagccgcggctgaagcacagggagccttcctgcataagacagaaaacggtttcgtgatggaaaacagtctggtatgcgccaggataaacggacagggcgaggtgacttccttccgtctgaagaacgaaaacgcaggggaaggcggactttcccgcgagtatgcggcagggccgatgaaccggctgcgcctgtttaaggacattccccgcaagtatgatgcctgggatattgattccaactatgtatgccaggaaattcagggagcatatgatgtcgaactgcagcctgcagaagaagggctggaagcggttctgaaggtgacaggaaagctcagtcagtccacctatacccagtacattcgtctggcggcggacagcagaagactggagtttgaaacgatcgtggactggaaggagctgcaccgtatgctgaagaccgcattccctgtaaatgtctatgcggaaaacggcataaacgagattcagttcggctatctggagagacctgcgcaccgttccagaccttacgatcaggagcgctttgaggtatgcaaccatcgctatagcgccttctgtgacggaaacagcggagccgcagtgctcaacaactgtaaatacggcatttccatgaacgggaacagcctggagctgactcttctgcgcgcttccgcaagcccggagatgcgtgctgacaataaggtacatcattttacctatgcctttacggcctgggaaggaagcttcatggattccgatgtggtgagacagggctatgagctgaatgtgaagccttatgtggcggccggaagcggacaggacttcagcctgctttccattgaccgggacaacatcattctggataccatgaaacctgctgaagatggaagcggcgacattatcctgcgcctgtatgaaagcaaaaaggcggctgtcactgccagaatacagttttcaccggagcttctgggagtgggcagcgctttgaacggcggagaggattgcgcgtcagactgccatgtgtatgcctgcgatatgctggaaaatgttgcggaagagcttccggtaacggatggagcacttgctctttccttccatccgtttgagattaaaaccatccggatttccagagaaaagtaa

SEQ ID NO: 2936 - DNA, 1845 bp, Unknown
  Description of Unknown: Clostridiales sequence
ttggttaaaaacagcagaggcataaacctgatttttattctgctgctgggagcgcttctggtcatggtatggaccagttccctgaatcaggtacaggataattatacggtcggagcgctgcagcaggatctggaggaaggacttgtgaccggcgcggtgatcgggcagaaccgggagacgccgacaggatcagttacggtgtcgctttcggatggacgcagcaggacggcatatgtgaccaatgtggaggatgcgatcgatctgcttgagcagtatgacatcgatccgctggtgcgggatgtaccgcaggaaagctggttcatgaattatatgcttcccgtgctggtgatggcggccgtgatcatgatctttttcttcatgatgatgaacgctcagaatgcgggagcgggggccagcggaaataaaatgatgaatttcggcaagagccgcgcccggatgagcacgggaaaggataacaggatcaccctgaaggacgtggccgggctgaaggaagagaaggaggatctggaggagatcatcgatttcctgagagagccttccaaatatacgaaggtgggagccagaattcccaagggcgtccttctggagggccctcccggaacgggtaagacccttcttgccaaggccattgcgggagaggcaaacgtgccgtttttcagcatttccggttctgatttcgtggaaatgttcgtcggtgtcggcgcctcccgtgtgcgcgacctgtttgaggatgcaaagaagaattcgccctgtatcgtgttcatcgacgagatcgacgccgtggcaagacgccgcggaacgggtatgggcggcggccatgatgagagggagcagaccctgaatcagctgctggttgagatggacggcttcggtgtgaacgagggcatcatcgtgcttgcggctacaaaccgggtggacattctggatccggccattctgcgtcccggacgttttgaccggaaaatcgcggttggcgcgccggatgttggaggaagagaagatatcctgaagctgcacgccagaaacaagccgctggcagaggatgtggatttaaagcaggtggcgcagaccacggcgggctttaccggagcggatctggaaaacctgctgaacgaggccgccattctggctgcgggcgccgggcgcgcctatatttcccaggaggatatcagaaaggccttcgtcaaggttggcatcggcactgagaagaagagccgtgtcatctccgataaggaaaagaagatcaccgcttttcacgaggcgggacacgcgattctcttccatgtgcttccggatgtggggcctgtttatacggtttccatcatcccgacgggaaacggagcggcgggctataccatgcccctccctgagcgcgacgagatgttcatgacaaggggcagaatggagcaggagatcatggtatccctgggcggccgcatcgcggagcagctcatctttgacgatatcaccacaggagcctccagcgacatcaagaaggccaccaagatggccaggatgatggttacccgtttcggtatgtccgaaaacatcggtgtggtgtgctacgacgatgatgatgacgaggtattcatcggccgtgatctggcccatgcaaaggcgcacagcgagatgatcagcggcgagatcgataaagaagtgaagcagatcatcgacggctgctacgcaagggcgacggagctcatccgtgaaaacatggatgtgctccacaaatgcgcgaacctgcttctgcagaaggaaagaatcaaccgggcggagtttgaggcgctgtttgaagagaaaaaatccttctttgagaatgcctga

SEQ ID NO: 2937 - DNA, 1800 bp, Unknown
  Description of Unknown: Clostridiales sequence
atgaaaaaagtgatacaaaagatccgggagagccggctcagtcttatcatgctgtttctggctccggcagccaccttttacctgctggagtggtacacccacaatccgtttgaaaccatgaagacgacgccgcaggtgctgaacctggtcatgtttgagctgctggcgcttctcctgtttgcagccttcgggaagctccatgtggcactgatgacggaaaccctgtttttcggcatatacggactcgccaactattttgtcctgaatttccgttcggtgccgatccagccctgggacctgctttccatcggaaccgcggccagcgtggcgggtaattatgattataccctggatcggcaggcgcttctggtggtgcttggcttcgtgcttcttctgattcttgaatttttctgccgcttttccctgaaaaagggaacctggaagctgcggcttcccgttgcggccacgctcgtcgtccttctgggcgctttcgggctgatgttccattccgatgaaatcgtggaacagaagctgcggctgtacaataagcttttcacccctaccaccatcagctataaaaacggaacggctctggccttcgtcatggagcttcggtatctgtccgtggataagcctgcgggctatcgtgcggatacggcggcgcaggagcttgccgctctggaggaggaatccatgagcgagcctgccatggccggttcaggcggagaagggcagcttccgaatatcatcgtgatcatggacgaggccttttctgatccggcgattctgggtgattttacggtgaatcaggattatatgcccttcgtccacagcctgctcgaaggctctgacaacaccatttccggctggctgaatgtgtccgttctgggcgggaatacagccaatacggaatttgagtacctgaccggaaataccatggcctttctgccgcagggaagcattccctatcagcagtatatcaaggcggagacaccttccctggcctcgcacctggcgggtcttggttatcagacggtggccatgcatccttacaatgcctccggctgggaccgggacacggtctatccggcaataggtttttcagagatgtatttccttccggactttgagaatccggtgaaggtccgtaactatgtaagcgatcagtccgattttgaaaaaatcattgagatctatgaaaataagggcgacaacccgctgtttctgttcaacgtaaccatgcagaaccactcttcctacacggaaagctttgacaatttcgatcctcagatcgaggtggatggcggttctcagaccctgaacaactatctttccctcctcagcctgagcgatgaggctcttggagaactggtttcctattttgagggacaggaggaggataccgttatcgtctttttcggagatcatcagaccaccaactcggtgattgagccgatcctgaagctgaacgggaagagcagctccaccctgacggaagaggaacaggcggaccgctataaggtgcccttcttcatctgggcaaattttgatattgaagaggaaacggacgtggagaccagcgccaactatctggccgccagaaccctggaagctgccggtgttccgctggacggatatttcacctggctttccggcttttccgaaacggttcccgtgatctccgccaatcatgtgacgctggcggacggtacctttacgaacgccgatgaccagtccgagcttctttccgactataagggctatcagtattacagactgtttgattattccgctgactga

SEQ ID NO: 2938 - DNA, 1266 bp, Unknown
  Description of Unknown: Clostridiales sequence
atggagcagttgaccgaagagaaaggatttgactggaaaggggcaaaaatggaggttatcagagcgggcgcgcagtggaaggaagaaattcttcgttttgctgacaggatattcgggaaggatgtgcagccgggcggctttgcggagctgattcctgatgtatacggaccggaggcggcctgcgacggaaatcaccttctcgttgtggaggatggaaggattcgtgcgcttttgctgaccgaaccgatatccttcgtgagcggcggcgaaatcctgaagggaatcggcgtaggaacggtgagcgttgcagaggatgcgcgcgggagagggtttatgcagcttctcctgaaaacggttcgggaatggatgacgaaggaaggatatgtcttcgcagttcttgcgggacagaggcagcgttatgcctactggggatatgaacccatggagatgaagatcagcatgcatctggatgcaggaaacggaaagcatggtcttgtccgtgcctgtgcagccggaggaaaggcaggcggaccggatgctgcttcgaacgaaaagacgccgattaccgttacggcggacgaagggatttcctttgcggagatggaggaagggagcgaagaggaggggctcgcgtttgagctctttgagcgcctccctctgcatacgctccgacagaaggaaaggtttgcacggcatctgaagtcaggaaggtgcattcctcttgttatccgggaaaacggccgctttgccggatatatgtgcgattccgtccgaaatgggaagcataaaatagcagagctggagcttgcggatatggagctgtacccggcagttcttacggcttactggaagcagagagcgccggagggcttttctgtggagctggcccccttccggatacaggaattctcttttctggaaaaagtctgcggaagctatgagctgtgcacgggacatcagtattatgtggcggatcttcccgcaatgctggatttctttctgcgggcgaaacagaggcttacgggcctttcggacggggaatggtcctttcaggtggaggagaggctgtactgctgcagcgtcaaaggtggaaacattcaggtaactgtgggtgccggtaagaaggataaaggcgttaaagaatgggaaaagggagagctggtgcgttttctgtttggcccttcttccgcggtctttggacttttcggagcaccggcaggatggtttccgcttcctctttatcttcccggagcggatgccgtatag

SEQ ID NO: 2939 - DNA, 1410 bp, Unknown
  Description of Unknown: Clostridiales sequence
atggctgaaaagtatgatgtaattattgtgggggcaggtccgggaggcattttctgtgcgtacaggctgctggagaagagaaaagatctgaaggtacttctgatcgaaaagggaaggcctattgaaaagagagtttgtccgaagcggaaaacgggcgtatgcgcaggctgccagccatgcgccatcacgacgggttttgcgggagcgggagctttttcagacgggaagctctccctgtccccggacgtgggcggaaatctgccgcagattctgggctatgagcggacgaaggagctgatcggggaatccgatgtcatttatctgaagttcggagcggacacgaaggtatacggcgtggataaggaaaaggaaatcaggaagatccgccgtaaggccatcaatgcgaacctgaagctggtggaatgtccgatccgtcatctgggaacggaggaaggctataaaatttattcccgtctccagcagcacctcatggaagaaggcgttttgatgcgcttcaataccatggtgaaggagatcctggtggaggacggacacgtgcggggcgtggtgacagacgcgggagagaccttccttgcggacgaggtggtctgtgcggtgggccgcgaaggagcggactggttcaaggataaatgccatgaaatcggtgtcgagacggagccgggaacggtggatatcggcgtgcgcgtagaggtgcgggacgaggtgatgcagttcctgaatgaaaatctctacgaagccaagctggtcttctttacgcccacctttgatgataaggtgcgcaccttctgtacgaacccctccggagaggtggcggcggaatattatgacggcgggcttgccgtggtgaacggccacgcctataaggcgcaggaatataaaacggaaaataccaattttgcccttctggtctccaagaatttcaccaggcccttcagcacgcccattgaatacggaaaaagaatcgcggagctgtccaacatgctctgcggaggaaagattctggtacagacctatggagatttcaaacggggaagaaggactacggaggagcggctgtgccgcaacaatctgatccccaccctgaaggacgcggttcccggagatctttctctggtgcttccgcaccggatcatggtggatatcgaggagatgatccgggcgctggataaggtgacacccggcattgcaagcgatgagacgcttctgtacggagtggaggtaaaattctactccaaccgtgtgatagtggaccgggattttgagacgagcattaagggactccgcgccatcggagacggggccggtgtgaccagaggtctgcagcaggcctccgcgaacgggctgagcgctgcggagagcatattaaagaggcttggtgcggctgaatga

SEQ ID NO: 2940 - DNA, 795 bp, Unknown
  Description of Unknown: Clostridiales sequence
ttggaaaaatcacgcggcagaaataccgccgggaaaggagcggccatggaccgtttcagggaaaaataccgtcacgagcagaagtttctggtggacgagagggacatcgccctcatcactgccagaatccgtccactgatgaaaccggacgcctttcatccggaaggcgcctaccgcatccggagcgtttactttgacgactggcaggactcggccctgcggcagaatctgagcggaatctctccccgcagcaaattccggatccggatctataacgagagcatggacgccatccatctggaacagaaaatcaaagcccatgatctcacgcggaagaaaagctgccgcctttcggaaacagaatgcctttcccttcttcgcgggagggcggttcgttccgctggaggcgacagaccgctttttacgctgctgcagacggaaatgctgctgcaccgccttcttccgagaatcatcgtggagtatgaacgaaccgcctatacctgccgggatggaaacgtacgcgtcacctttgaccggaatctggcatcctccgattatgtgctgcgctttccggatcaggagcttcccaaacggcctgtcatggctgccgggcagcatatcatggaggtaaaatacgatgaatttctccccggttttatccgaaaggcgctggatacgggaaagctggagcggatcaccttttccaagtatgtgctctgcagaagccatgctttaagcgggacctcacagaagacagcctccctctccttttcagatacgaaccggctgatttaa

SEQ ID NO: 2941 - DNA, 1224 bp, Unknown
  Description of Unknown: Clostridiales sequence
taccgttatgagcctccggcgcaggaggaacttctgcgtcagaaaagggaagcggaaacctttgagaatccgccccttctttccgtggttgtgccggcatatgaaacgccgcctgatttcctccgcgccctccttgactgcatggaggggcagagctggatcaactgggagctggtggttgcggacgccggaagcacggacacggtgagacaggtggtggaggagcggaaggatgtgcgcatccgttatctgaagcttactgaaaaccttggaattgcgggaaataccaatgaagcgctgaaggcggttcgcggaacctacaccggccttctggaccatgacgatcttctgacgccggacgctctgtatgaaatggcctgtgcactgaaggaaagcgaagagaagggaatcaccccggtgcttctctattcggacgaggataaatgtgacggcggtggacaggttttttatgagcctcacaggaagccggatttcaacctggatctcctgctttccaacaactatatctgccatttcctgatgctgagaacggatgtgttccgacgcctgaaggagcgttccggctatgacggcgcgcaggattatgatcttgtgctgcgggcggctgcgggggtgctttccggagagccggaggcggcctatgtccatgtgccgaaggtactctatcactggaggtgccatgagacctcaacggcctccaatccggaaagcaagcggtatgcctatgaggccggaaagcgcgcgctggaggatttctgcgccgctcagggctggagggtgcaggtggaggatacccggcatctgggattttaccggatccgctatctgccggatattcttgcggtcagaaaggatgtgggggccgcagcatatccccttcccccccgccggggaaggctgcagagcgggatctatgacagaaaggatggagcgcttttgatgcgctacgcgggtctgccccgtcatttcagcggttatatgcacagagccgttctgtcgcaggatgtggaggccgcagatgtgcgcaccatgcgggtgcgaaaggacggtgagccctcccggctttcagaggagcttaaaaacgcgcaggaggcggtgagacagggagcggatcccgcggaaaccagctccgccttctgccggaaaatccgcgggatgggataccggatctgctgggatcccgacggaacccgccttttgtga

SEQ ID NO: 2942 - DNA, 1224 bp, Unknown
  Description of Unknown: Clostridiales sequence
atgaaggagaaagattttatggtaaagatacagaagaagaggaaaggaatggcctccctctggcgcaggacggctgcagtctgcggcgtcctgacgctgacggcttcgcttcttgcgggatgtggacagaaggagaatgaggaaacgcagagcattgcggcggttgaggatcagagcgtatctccggaagaacaggcggaagcggacgagacgggagaacagaccaacgaggaaaatgccgcgctggtggaaaacgacggagagcacagcttcctgaccggcgagccgagagatccggaagcagtgaacgaacggccgcttgccgtgatgttcaataatctggaggagggctgccctcagaccggaattgagcgggctgccatcgtgtatgaagctcccgtggagggacggatcacgcgtctgatgggtctgtttgaggattatgatgagctggaccggattggctatatccgttccagccgtgattattttgtttactgcgcgctggaatatgacgcaatttatgcccattttggccaggcaacgccttatgtgggagccctgctcaacagcgaccgggtggacaatatcagcggagccgttgctggaattgatcatccggcgaccaacaccttcctgcgaaccagcgacagaaaggcgccgaacaacgtttatatcgatgtgaaagggctgatgcaggacattgaccggttcggctacagtctgacctatcacgatacccataaggcgaagttttcctttgcggcagatggagaaaaggcgaaaaattccggaaccgcggacgccgttatgctttatcccggcggaaaggaaaacaatctggcaaacggctacagtctggtggaagccaggtttgaatacaacgaagaggacggaaaatattaccgttatcagtatggcggacctcagatcgatgagagcaccggagatcagcttgcctatgataacgtgatcttccagtactgttatggagaggtgcgggacgataacgattatctggctttcgaactgcacggggacaacgggatgaaggttcaggtgtttaccggaggaaagatgacggaaggaacctggtcccgctactcggataacgatcccgcctattatgtggattctgaaggcaatccgatcacgctgaaccagggaaagacctggatctgtctgatctgggagaagtatgcggacgatgtggtcatcgaataa

SEQ ID NO: 2943 - DNA, 3012 bp, Unknown
  Description of Unknown: Clostridiales sequence
atgattctggaaaagtactatgagaacccggaagtcctgcatgtgggctgtgaggaaacgagatgctggtatatgcctcttgacgggcaggaaaaggagacggggagactcctttccagcgtggactggagatttggctattttccctgcatcgaggatgttccggaattttacaaaaaggattttgacgaggagagcttcggaaggctggaggtaccttcctgctggcagatggcgggttttgatcagaagcagtataccaacacccgttatccattcccctgcgatccgccctatgtgccggacaataatccgtgcggggcgtacataaaggattttgacctggataagaatgagacgaagaaagagcagtttctttattttgagggagtggattcctgcttttatgtgtgggtgaacggaaaatttgtgggttacagccaggtttcccacagtcccagcgagttcaatatcacgggaaagacgaaagcgggaaggaaccgtctggccgtccttgttctgaaatggtgtgacggaagctatctggaggatcaggataaattccgcatgtccggcattttccgggatgtgtatctgctgctgcgcccgaaggagagggtgcgggattacacggtgaccacgcccgtggattttgaaaaggacagcgcgcaggtccggatcagactggatgcggtgggaacgccgcaggtggaatgtgccctgtatggcggagaaacgctgcttgcacagcaggcacctgacgcggacggaacggtttcctttaccgtggagcatccggttctgtggaacgcggaggagccttacctttatacggtaaaaatcagcacgccggaggaggttatctgccagcgggtgggaatccgcaccattaccatcaaaaacggtgtggtcctgatcaatgaaaagccagtgaaattcaagggagtcaaccgtcatgacagcagtccctttaccggagcggtgatctcaaaaatggatgccatgttcgatctgcgcatcatgaaggaggcgaatatcaacgccatccgtaccagccattatcccaacgcgccctggttcccggaactgtgcagcgaatatggcttctatgtgattgcggaggcagacctggaatcccatggaatggcaaatcagtatggaggaggaacggaaaagactttcagccagctcgtggaagatcctgcctacagggaggcggtgattgaccgcagccggcgcaacgtgatccgggataagaaccagtgctgtgtcattttctggtccctgggaaatgaatccggcataggaaccaatattgaggaagcgggacgctgggtgaagcagtatgatcccaccaggctggtgcattatgagagctgccatttccagccggagggacatgtgaaggacgagtccatgctggacgtggaaagccatatgtatgcttccacacagcagatcgatgaatattttgccgcacccggggagaaaaagccgtttatccagtgcgagttcgtgcacgccatgggaaacggccccggagatattgaggattacatgcagcagatctacaaatatgacggattctgcggcggcttcgtctgggaatggtgtgatcacgccacctatgagggaaaggcggcggatggccgggaaatgtaccattacggcggagatgcgggagagtatcctcatgacggaaacttctgcatggacgggctggtgttcccggaccgcagacctcatgaggggctgtatgagtggaagaactgcatccgtccggtgcgcgccgagctgaccgatcggaaaaaagggattgtgcgtctgcacaacatgctggatttcaggaatctgaacggctatgtccggcttcagtatgagatcaaaaaggcgggagagctgctttccgaaggctccgttgatgtgctggatatcgcgccccatggctgcggggatattcagatcgatctgcccggaaagaaggaggaggactgcttccttctgatcacctattatcaggcatcgaaggataagctgactcagatcggccatgtgatgggatttgaccagatcccgctctctgagccgaaggaaagggagcttccctttgcaaagattcccgccggtgaaaagggcagcgtgacgcttacggaaaccccatacgcgttctgtgtgtcatgttcatcaggagaaaatttccggtacgagttcggcaaaaaggaaggaaatttcatccgcatggaaaagaatggggaagcctgcattaccgctcctgtggaatggaacgtctggcgggctcccacagacaacgacagaaacatcgtcctggaatggcggaaggccggttatgacagaagtacggtgaaggtttatcgggtggaagcgaaggtgcgtcagaatgtggcagtcatcacctgtgacttttccatcgcggcgccggtgatacagcctttcctgcatctgcatgcggtatggagcattaacgcagccggacaggtgaagctggttctggaaggaaagcgcaatacggtatttccgttccttcccagattcggcctgaaattctgtctgccggtgacagcggagaacggagaaaagacggaggcgggtgatgtgccggtatcctatttcggctacggcccgcacgaaagctacatcgacaagcacagagcgagctatatggacctgttttccacaacggtgggcgcgctgcatcaggattatatccgtccccaggagaacggaagccattataactgttcctttatgcaggcaggaggctttatggcgcagggaaaacgtcccttctcctttaacgcttccgaatatacgccggaagagctgaccgaaaaggcgcataactacgaactggaaaaagccggatgcgtggtggcatgcaccgattacaagatgagcggcgtgggatccaattcctgcggcccggcgcttcttgagcagtaccggtttgacgaagaagaattccagtgggagatgctgtattcctttgactga

SEQ ID NO: 2944 - DNA, 936 bp, Unknown
  Description of Unknown: Clostridiales sequence
gccgtgttcggagatatcttcatgcgctgcgtttatcggatgcggccctatgagctgactcccggcagcgttgaggactgccaccggaaatgggtggacagatgcgttgccttcctgacctcaaaacgtcccggcattccgacattctttaagatgtgccggcagatgatcgaagactttgacaacattccgatttcggatgttcccaagccccgtgtcggcattgtaggtgagattctggtgaaatttgctcccgccgccaacaatcatctggtagagcttctggaggcggaaggcgcggaagcggttgttccggatcttctggacttcatgttctactgcttctacaaccagctttacaaggcggaccatctgggaaccagcaaaaagacggcctttatcgcaaaggcgggtatccgggccatggaatggatgcgttccggagcgagaaaagcctttgagaagtcgaagcatttccatgcgcccacaaggatcgagaccatcgcttcctatgcggagcccatcgtttccataggaaatcagacgggtgaaggatggttcctcaccggagaaatggtggagctgatcaagagcggtaccaacaatatcgtctgtacccagcccttcggctgtctgccgaaccacgtggtgggcaaaggtgtgatcaaggagctgcgcagacggtatcccaagtccaacgttgtcgccatcgattacgatcccggcgccagcgaggtaaaccagctgaaccgcatcaagctgatgctctccacagcgcagaaaaacctgaaaaaggagctggaggaatccgggcagttaaagtccgtgcacaagcccgtacaggatcagaataaatctgcgcaggagttttctcagaagaatgactccaataccatacaggaaagcctggctgaggatgaaagaacctccgcctga

SEQ ID NO: 2945 - DNA, 2028 bp, Unknown
  Description of Unknown: Clostridiales sequence
atgcggcatcgccgtaaaaagaaaagaatgggggataaaaccatgcagatttatgttgacgctgctgcccttcgggatggaaacggcagcaaggaaaggcccttccggcatatcaatgacgcggcccatattgcgaaggcgggagatgagattctggtctgccccggcgtataccgggaatatgtggacccggtaaatgccggaacggaagaaaacagaattatctaccgcagtaccgagccgctgggggctgtgatcaccggagcggaagaggtgaagagctggaagccgtatgaagggaatgtatgggtctgccggattggcaacagcctgtttggcggttataatccctacaccacctatgtgtatggggactggtactttgccggcaggagcaaacacacaggcgctgtctatctgaacgataaaatgctctatgaagcggacagcctggaagcctgcatcagaggagagatctgggagtgctcctgggaaccggaggcttccgtgtacaaatggtatgctgaacaggacggagaggagacggtgatttatgccaacttccaggggaaaaatcccaatgaggagaaggttgagatcaatgtgcgcagggaatgcttccttccgtcgaagaccggtgtgggatacattacggtaagcggcttccggattgaaaaagcagctaccacctgggcgcctccggccgcgtatcaggatggcatgatcggaccgcactggtcgaagggctggatcattgaggactgtgaaatcagcaacagcaaatgtgccggaatcagccttggcaagtatctggatccggacaatgaccattactttacctataagcatgtgaagagtcctacgcagatggagcgggatgctgtatgcagaggacagtatcatggatggctgaaggaaaaagtgggaagccatatcatccgccgctgcaacattcatcactgtgagcaggggggaattatcggccggatgggcggagttttctctgtcattgaagataaccatatccatcacatcaataatatgatggagctgggcggggcggaaatcgcgggcattaaaatgcatgccgccatcgatgtgatctaccgccgcaaccatatccaccactgcaccatgggaatctggtgcgactgggaggcgcagggaaccaggattacacagaatctgttccatgataatcagcggcctgcctttgccagacagttaaagggcggcatgatgagccaggatattttcgttgaggtgggacacggccctaccctgatcgataataatattctcatgtccgacgtatccctgaggatggcgacacagggcgtcgccatggtacataatctgatctgtggagctctgacctgtgtgggcggaggcaccgggccgcgttatacgccctatcatatcccgcaccgcacggaggtgatgggattcatgaccatcctgcacggtgacgaccgcttctataacaatatttttgtacagaaatggccgaaggaagcttttaccgtcctgcgcgacagcagcgaaggttccgatgaggaaaaccgggaagtgggaacccatgtaatggacgaatatcccacctatgaggaatggatccggcagtttgacatggacacggatacgccggacatggcaaagctggagcctgcgcatggcggacatcttcctgtatgggtgaagggaaacgtctattttaacggagcgaaggcctgcaaaaaggaaacacataatctgatagatggtgaacatgaggtgagagttgatgtcctgatgcaggacggaaagccggttctttccaccaacctgtatgattttctggatggatttaaggcggacatggttaacagtgatgttctcggtaaggcctttgaaccggaggaacggtttgaaaatccggatggaacgccgattgtctttgacagagactatttcggcagccatcgtggaacggagatcctgcccggtccgttcgcaaaggcgccggaaacggacagaaaactctggtaa

SEQ ID NO: 2946 - DNA, 1845 bp, Unknown
  Description of Unknown: Clostridiales sequence
ttgaaaaagaaactcccttatctgtttaccgcggtcttttttctcggctttgccgccgtatttctttacttttttctgaacagcgacgccagacgcttccggctggtgacggaaaactttttcacgtcgtctctggccggagacagtctgagccttcattatacgctggccgatccatccccctggctggaagggccttccccggcctcacttccgatctattccagatctggaagacaggaaagcgcagctgtcatggaaaatctgctcaccgctctctgggaaatcgacccggagcagctgaatgagcaggattcctataccctgtctcttttgacttcctggctggaaaatgaactggtcggagcgcagtgtgaatattttgaagagcctctgtctccaacctcgggcatgcatctggaggttcccgtccttctggcggaatatgccttccgaagcagggaggatctggaggattatctggaagtactggagagcattccggactatctggaaggtctgggagaatatgaaaaggaaaaggccgccgcagggctttttatgaccgaagaggatgcggccgaagtggtcagtcagtgtgatgctgttctggatgaaacgctgctggagagcggaactcattttctgcagaccacctttgcggaacggctggatcggctgattgagctgggagaagtagaggcacatgaccgggaaaaatatatttcggaaaatgacaggcttctgaaaacggtagccgcacccgcctatgaagcgctgggagacaccatttttcttctttccggaagcggactgtatgaaggagggcttggacggatatccgggggaatcgtttattatacttatctgctgaaacgcaatacgggttctttcagaactccggaggagatcacgcgtcttctttctgagcagcttcaggctgatgttcaggagcttcaggagctttccggccgttatcagcagcttaccggacatacgccggactccgcctccaccctgtttccgtttccctttgaggatgcacaggagattctgacagacctgcagcagcgcatgcaggacgactttccccctctttctgcgctcactgatgttcctgtcttctgtactgccaagacggtttccgaaagcctgcaggactatacctccccggcattctatctgataccgccgctggatgatctgactgaaaatgtaatttatgtgaatccggcttccaccagacctggtctggagctttataccaccctggcacatgaaggctatccgggtcatctgtaccagaccgtttacagccggctttatgagaattccataactgataatccggttcgcggcgttatctcctttaatggctttgtggagggctgggcttattatgtagagaatatttcctatgactatgctgcagacgtgcttctggaaaacggcggcacagaagctgaccgggtgcttgttcagcttctgtgcctggagcggaaccttcagatcaatctatactgccttctggatctgtccatccattattatggagctgatcgggaggatgtcttccgctccctggctgccttcggcatttctgacaccacgacggcgggggccatctacgattatatccgcagggagccaaccacctatttaaagtattatctcagttatctggagattctttccctcaaggaagaagcacaggaactgtggaaggaacagtattccgatcttcgctttcataccttcctcctgcagacgggaccctccgattttgtgaatctggaaaaacgtctgagggaacagaatccgggcgcacagcagccgaaagtgtaa

SEQ ID NO: 2947 - DNA, 1818 bp, Unknown
  Description of Unknown: Clostridiales sequence
atgaatgaggtaaaaaccccaaaaaagccgtttatattttattacgtcatcgtgctgctcgtcctcatgctgctgaattttctggttatgcccagaatgctgcaggcaagcatcaaggaagtggactacggcaccttcatggacatgatcgatgacaaaaacatcggagaggttgaagtagagagcaaccagattatttttacggacaaggacaatactcagatttataaaacaggcccgatgttcgatccggggctgacggaacggctgcatgattccggagcggtgttcgcctccgagatcgtagagcaggcatctcccatcgtgagctttctggtttcctgggtgctgcccatcgcgatctttgtaggcctgggccagtggatgtataagagaacgatgaacaagatgggcggagattccatgatgttcggcatgggaaagagcaatgcgaagatttatgtgaaatcctccgcaggcatccgcttcagcgatgtggcgggcgaggatgaggcgaaggaaagccttaccgagatcgtcaactatctgcatgatccgaagaaatatgaggaaatcggcgcatccatgccgaagggcatcctgcttgtcggccctcccggaaccggtaaaaccatgctggcaaaggcggtcgcgggagaagcaaacgtgccgtttttctccatctccggttcggaatttgtggaaatgttcgtgggtatgggcgcctctaaggtgcgtgacctcttcaagcaggcgaaggagaaggctccctgtattgtgttcatcgatgagatcgatgccatcggggaaaagagaggcggacagtacggcggcaacgatgaacgggagcagacgctgaatcagctgctgacggagatggacggatttgaaggaaatacaggggtcatcatcctggcggcgaccaaccgtccggattctctggatcctgccctgcttcgtcccggccgttttgacaggcgggtacccgtagaactgcctgacctgaagggaagagaagagattctgaaagtacatgcgaagaaggtaaaggtggattccggcgtggacttctccgttatcgcccgcatggcctcaggcgcgtcaggcgctgagcttgccaacatcgtcaatgaagccgctcttcgtgctgtccgcgacggacgtaagacggttactcaggcggatctggaggagagcatcgaggtggtgatcgcaggctaccagaagaagaattccatcctgacggatcaggagaaaaagatcgttgcctatcacgaaatcggccatgcactggttgccgcaaagcagaccaattcagccccggttcagaagatcaccatcattcccagaacctccggcgcgctgggctataccatgcaggtggacgaaggcaaccattacctgatgaataaggaagagatagaaaacaagatcgccacgctgaccggcggccgtgcggctgaggaagtggtttttggttccatcaccacaggcgcttccaacgacatcgaacaggctaccaagctggcccgcgccatgatcatgcagtacggtatgagcgatgacttcgacatggttgcactggaaaccatcaccaaccagtatctgggcggcgatgcttccctcgcctgctccgctgatacccaggcagagatcgacagacaggtggtagagctggtgaagagacagcatgaaaaggctaggaagcttctggagaacaatcggaagaagctggatgagctggccgagtatctgtataaaaaagagaccattaccggagaagagtttatgaatattctgaacgctccggaggcataa

SEQ ID NO: 2948 - DNA, 1152 bp, Unknown
  Description of Unknown: Clostridiales sequence
atggagggaaacatgagcgatgcattcaaagactttgccgacactcctaccctgactctggagcctgacctgggggatgcacccgcggctcctacaccggtggaaaaggaggaggtacaggagctggacgacagcatcctgagcgatgaagaaaggcggatggtggacgaattctccaggcagatcgacctgagaaattccaacatgatcctgcagtacggcgcaggcgcgcagaaaaagatggcggacttctctgagaaggcgctggaaaacgtgcagacccaggacctgggcgaggtgggtgagcttctgggaaacgtggtgacggagctgaaaagcttcgacgcggaggaagagcgcggcattctcggctttttcaaaaggggcgccaacaaaatcaccgcgatgaaggcgaaatatgcaaaggcggaggcgaatgtgaaccggatctgccaggtgctggaaggtcatcaggttcagctcatgaaggattctgccatgctggacaagatgtacgagctgaacagaacctattttaaagagctttccatgtacattctcgcgggaaagaagaagctgcaggaggtgcgggaaggggagctgaagcgtatttctgaaaaggcgcaggcaagcggcctcccggaggatgcgcaggaggcgagagatctggatgccatgtgcaaccggtttgaaaagaagctccacgatctggagctgacacgcatgatctccattcagacggctcctcagatccggctggtgcagaacaacgatacgatcatggtggaaaaaatacagtccacgctggtgaatacgatcccgctctggaagagccagatggtgctggccctcggcgtggagcattccactcaggctgcggcggcccagcgtcaggtgacggatatgaccaatgagcttctgaagaagaacgccgccacgctgaagaccgcttcgattgagactgcgaaggaagctgagcgcggcatcgtggatatggaaacgctcaaggctaccaatgaatccctgatttccaccctggacgaagtgatgcgcatccagcaggagggcagacagaagcgtcaggaggcggaggcggagatgagccgcatggaaaatgagctgaaggcgaagcttctgcagatcagcggttaa

SEQ ID NO: 2949 - DNA, 2079 bp, Unknown
  Description of Unknown: Clostridiales sequence
atggcaaaatatcttgtaatagtggaatcacctgcaaaagtgaaaacgatcaagaaattcctcgggccgaattatgaggtggccgcaagcaacggacatgtgcgggacctgccgaagagcaagctgggaattgacgtggagcacgattacgagcccaaatatatcacgatcagaggaaagggggacattcttgcgaatcttcgcaaggaagtgaagaaggcggaaaaaatctatctcgcaacggaccctgaccgggagggggaggcgatttcctggcatctgatggaagcgctgaacttaaagaacagtgggaaaaaggtgtaccggatcacgtttaatgagatcacgaagaacgcagtaaaggaatccctgaagcatccccgcgagatcaacatggatctggtggacgcccagcaggcgagaagagcgctggaccgtatggtcggataccgtatttcaccgcttttgtggtccaaggtaaagcgcgggctttccgcaggacgcgtacagtctgtcgctctgcgcatgatctgcgacagagaggatgagatcgccgcattcattccggaggaatactggacactggatgcttcctttaagatcccgggagagagaaagcttctgaccgcgaaatactatggcaccccgcagcagaaggtgaacctgaccagtcaggcggacgtggaacgggtaatcgcggagcttgacggcgccgactacagggtgagcgaggtaaagaagggagagcgggtcagaaaatcgcctcttccgtttacaacgtcaacccttcagcaggaagccagcaaggtgctgaatttttctacgcagaaaaccatgcggctggcacagcagctctatgaaggcgtggacatcaaggggagcggtacggtgggtgtgatcacctatctgcgtaccgattccacccgcgtatctgaggaagcggagcatcaggccgccgattatatcacaaacacctatggcgctcagtatgcaggggaaaagacccaggccaggcagagcggtcagaaaatccaggatgctcatgaggccatccgtcccacggatattgaaaggacgcccgctgagcttaaggaatccctttccagggatcagttccgcctgtatcagcttatctggaaacggtttgtggccagccgtatgacgcctgccagatatgagaccacctcggtgaaaattgatgcggcaggccaccgcttcaccgtatccgcgagcaaaattgcctttgacggcttcatgtgcgtctatacgcaggaggatgatgaaaaggcggaaggcaatatgctggccggaagcatcgatatggatacgaagcttaccttcgacagcttctcccaggaccagcattttacccagcctccggctcattatacggaggccagcctggtacgcgctctggaggagcagggcatcggacgtcccagcacctatgcgcctacgatcactacaattctggcgagaaggtatatcgttaaggagaacaagaacctctatgtgaccgagctcggagaggtggtcaacaacatgatgaaggaagccttccccagcatcgtggatgtgaatttcaccgccaacatggaggcgcttctggacggcgtggaggaaggcagcgtaaaatggaagaccatcatcgagaatttctatccggatctggataaagctgtggagcaggcccagaaggatctggaccaggtaaaaattgcggatgaggtatctgatgagaaatgcgagctgtgcggcaggaacatggtgatcaaatacggtccgcacggacgcttcctggcatgcccgggcttcccggaatgccgcaacaccaaaccctattttgaaaaaatcggtgttccctgtccgaaatgcggtaaggacatcgttctgaaaaaaacgaaaaaaggacgtaaatactacggctgcataggcaatccggactgtgatttcatggtatggcagaagccttctaaggaaaaatgtcccaaatgcggttccctgatgctggaaaagggaaataagctggtctgctggaatgaggactgcggaaccgttgtggagaagaaggaaaattga

SEQ ID NO: 2950 - DNA, 1638 bp, Unknown
  Description of Unknown: Clostridiales sequence
atgatacaagcggtaaatgtcactttaagactgggaaaaaaggcattgttcgaagatgtgaacatcaaatttacggaaggcaactgctacggtctgatcggtgcgaacggagcgggaaagtccacctttttaaagattctttccggccagctggagcccaccaacggtgaggtggtcatcactccgggccagcgtctttccgtactggagcaggatcatttcaaatatgatgagtttccggtgctggacaccgtcatcatgggaaacgcccgtctgtatgagatcatgaaggagaaggaggccatctacgcgaaggaggacttctccgatgaggacggtatccgggcaagcgagctggaagcggagtttgccgaaatggacggctgggaagcggaatccgacgcggcaagcctgttaaacggcctcggcatcgagacggaatatcattacagcctgatgaaggacttaaacggaagccagaaggtcaaggtgctgctggcgaaggcgctgttcggcaatccggacatcctgttgctggatgagcctaccaaccatctggatctggacgccatcgcatggctggaggatttcctcatcgattttgaaaatacggtgatcgtggtatcccatgaccgttatttcctgaacaaggtctgcacccagatcgcggacatcgattatggaaagatccagctgtacgctggtaactatgatttctggtatgagtccagccagctgctcatcaagcagatgaaggaagccaacaagaaaaaggaagaaaagatcaaggagctgcaggaattcatttcccgtttctccgccaacgcttccaagtccaagcaggcgacctccagaaagcgcgctcttgagaaaatccagctggatgagatccgtccctccagcagaaaatacccctatattgatttccgtcccgacagggaaatcgggaatgaagtgctcaccgtggaaggaatttccaagaccattaacggagaaaaggtgctcaacaacatctccttcatcatggggcacaacgacaagatcgctttcgtgggcggaaacgagctggcaaagaccactcttttccagatcctcatgggtgagctggagccggacgaaggcacctacaaatggggcgtgaccacatcccaggcctacttccccaaggacagcacgaaggagttcgacaacgatctgaccatcgcggactggctgatgggctattccccggtaaaggacatcacctatgtgcgcggcttcctgggaagaatgctgttcgcgggcgaggacggcgtgaagaaggtccgcgtcctttccggaggagaaaaggtgagatgtctgctttccaagatgatgatttccggtgcgaactgcctggtacttgacgaacccaccaaccatctggacatggaatccattaccgcgctcaacaacggactgatcaagttccccggcgtcgctctcttctcctgccgtgaccatcagttcgtgcagaccacggccaaccggatcatggagatcctgccggacggcacgctgatcgataagattaccacctatgacgagtacctggcaagcgacgcgatggcaagaaagcgcaccatctataccgccaacaaggaagacgacgagaattaa

SEQ ID NO: 2951 - DNA, 693 bp, Bacteroides stercoris
gcgcagctatctgcacttcctgatattcctgaacttctgtattttcgtctatataggactgcaacccgctctgtatccccatctgttctctctgctgctaatcggcaccagtattctgataggacacttattcgtactgaccaacagccggagttccaacctgttcttcatcattatgctggtcggattatttactttattcggattcaatctatggacgcttttatagatacactcatacaactcctgatagactggggatatgcagggctctttatctcggccttattggcgggaagcatcattccgttcagttccgagctggtgatgctggcactcgtcaaggtaggcttgaaccctgccatctgtgttcttgccgccacactgggaaacacaatgggcggtatgacctgctattacatgggacatctcggcaagacagactggatagaaaaatatttcaaagtgaagcaagaaaaaatagacaaaatgcagcgtttcctgcaaggtaaaggagcgctcatggctttctttgcctttctgccctttataggagaagccattgccatagcactgggatttatgcgcagcaacgtaatgctgacttccctttccatgtttacaggaaaactgatacggtacatcgttatgttatcggctcttcaaggcgctttgtcggtgatgagtgtttag

SEQ ID NO: 2952 - DNA, 987 bp, Bacteroides stercoris
atgagtgagaaaataataaaatggggatttatcggctgcggagaagtgaccaaatacaaaagtggacctgcatttcagaaaattgaacactccgaagtggtagctgtgatgagtcgggatatctccaaagccaaagcttatgccaaagaaagaggcattgccaaatggtacaatgatgcacaggaactgattaatgatgaagacgtaaatgccgtatatattgccaccccaccctcttcccatgccacatatgccattatgtccatgaaagccggcaaaccggtatacatagaaaagccgatggcagtgacttatgaagagtgttgccgcatcaaccgtatttcccaagaaaccggcataccttgttttgtagcctattaccgccgttatcttccttatttcctgaaagtaaagtcattggtggaagaaggggccatcggaaatgtcatcaatatacaaattcgttttgcccagccacctcgcgatctggactataacaaggagaacctaccctggcgtgtacagcccgatatcgccggtggcggttatttttatgatttggctccacaccagatagacatactgcaagatatgttcggatatattcttgaagccaacggatacaagagcaaccgtggcggactatattctgcagaggataccctcagtgcctgtttccaatttgacagcggtctggtaggcagcggctcgtggtgtttcgttgcacatgagtctgcacgtgaagaccgtatcgaaatcatcggagacaaaggtatgatatgcttttctgtatttacctatgatcccatagccttacacaccgaacgaggaagggaagaaatccctgtagaaaaccccatttacgtccagcaaccgcttattcaagctgttgtagaccatttacttggcaaatcaatctgtaactgcgatggcgaaagcgcaacactgacaaactgggtaatggacaaaattttaaataaaatataa

SEQ ID NO: 2953 - DNA, 711 bp, Bacteroides stercoris
atgatggattttaaagagggagaagttctgtatttcaataagccgctggggtggacatcgttcaaggtcgtagggcatgcgcgttaccacatttgtcggcggatgaaggtaaagaagttgaaagtaggccatgccggtacactcgacccgcttgccacaggcgtgatgatagtatgtacgggcaaggcgacaaagcggattgaggagttccagtatcataccaaggagtatatcgccaccattcggttgggcgctaccaccccttcctatgatttggagcacgagatagacgctacctatcctacggagcatatcacgcgggagctggtggaggagacattgaagaagttcacaggcgagatacagcaggtgccgcctgctttttcggcttgtatggtgaacggcaagcgcgcctatgaccttgcccgcaaaggtgaggaggtagagctgaaacccaagttgctggtgattgacgagattgaactgctggaatgcaacctgccggaaataaaagtccgggtagtatgcagcaaaggcacttacatccgcgccctggcacgcgacatcggtgaagcgctgcatagtggagctcatctcacggccctggaacgtacccgtgtgggggatgtccgcatagaagactgtctgaatccgcttgatttcaaagagtggatagacgggcaggatttagttatgagtgatgggttataa

SEQ ID NO: 2954 - DNA, 780 bp, Bacteroides stercoris
atgatagaaacgactgattttagtaaatcggaacaatataccttatccatccgtctcagtacggatggattttctttttctatattcaatccgctcggcgaaggcagattttctttccacgagcacggagtggacgattccctgtccctcactgccaacctgaaacaggctttccgcgaaacggactggctgaagaatcctttccgccgtatcaatgtccttatggcaggcaaacgctttacattcattccgttggaattctttgaggacgaacaggcggaaaccgtattctatcataatcactccagacaagacaacgagctggtgcaatacaacatcttgcataagaacaatatagtcgtactgtttggaatggacaaaagcgcctgctcccttttacgcgaacagtatcccgacgtccgtttctatgcgcaggcaagccctctcatagagtactttgcggcaaagagccgcctgggcaattgccggaaaatgtatgtgcacctgcgcaaagaagcgacagagatatacgcctacgaacgcggccggctggcattcgccaacacctttgcctgcaaggagacaaacgaccgcctctattacatcctctgtgtatggaagcagctcggcatggcgcaggaacgcgacgagctccacctcaccggcgaactgtacgacaaagagcaactgctgcccgaactgaaaaaatttatccggcaggtattcatcatgaaccctgccgccaatctcgacctacaagccatcaacctatgcgagtaa

SEQ ID NO: 2955 - DNA, 615 bp, Bacteroides stercoris
cttaaacggatgttaataataggaattgcaggcggaaccgggtcgggaaagaccaccgtcgtacgtaaaattgttgaaagcctgccggctggtgaagtagttttattacctcaggactcttattacaaagacagcagccatgtgccagtagaagaacggcagaatattaatttcgaccacccggatgctttcgactggggacttttgtccaaacacgtatccatgcttcgcgaaggcaaaagcatcgaacaacctacctattcctacctgacctgcacgcgacagcccgaaacaatccacatcgagcctcgggaagtcattatcattgaaggcatccttgccctatgtgacaagaagctgcgcaacatgatggacctcagaatctttgttgacgcagacccggacgaacgccttatccgcgtcatccagcgcgatgtcgtagagcgtggccgcacggccgaggctgtaatggaacgctacacgcgtattctgaaacctatgcatctgcaatttatagagccttgcaagcgatatgccgatcttatcgtaccggaaggcggaaacaatcaggtagcaatcgatattctcacaatgtatatcaaaaaacatttataa

SEQ ID NO: 2956 - DNA, 1200 bp, Bacteroides stercoris
atgaacccaaaaacagtgataaaaggaaaaatccactatgtgggagtgaatgaccgcaataagcatttgtttgaaggtatgtggccattgccttacggagtgtcttacaactcttacctgatagacgatgaaacggttgcgctgattgatactgtagatatttgttactttgaggtatatcttcggaagataaagagcataatcggcgaacgtcctatccagtatcttatcatcaaccatatggaaccggaccattccggctctatccgtttaatcaaacagcattatcccgacatcatcattgttggcaacaagcagactttcggtatgatagaagggttctatggcgtgacaggcgagcaatatatggtaaaagatgaagactttcttgccttgggtcaccacaagcttcgtttctatatgactccgatggtgcactggcccgaaaccatgatgaccttcgatgaaacggaaggcgtgctgttctccggcgacggcttcgggtgcttcggtacgctcgatggcggattccttgatacacgcatgaatctggataagtattggaacgaaatggttcgttattactccaatatcgtaggcaagtacggctctcccgtacagaaggcattggcaaagttgggcggtctgcccatctccaccatctgctccactcacggaccggtatggacggataatattgccaaggttatcggcatctacgatcgcttgagccggtatgcggccgaagagggtgttgtcattgtctacggttccatgtacggcaataccgaacaaatggcggaagccatcgctgcggaactttccgttcagggcatcaaaaatattgtgatgcacaatgtcagcaaaagtaatccgtcttacatcatagccgatatattcaaatacaggggtctgataatcggaagccccacgtatagcaaccagatttatccggagatagaatcactgctctccaagatattggtacgtgaggtgaaaggccgttatctgggttacttcggttcgttctgctgggcaggtgcagccgtgaagcgcatgggcgaatttgccgagaaaagcaagtttgaaatcgtgggcgatccggtggaaatgaagcaggccatgaaggacattacctacgagcaatgcgagaatctggcacgcgccatggcggagcgtttgaagaaagacagacaataa

SEQ ID NO: 2957 - DNA, 618 bp, Bacteroides stercoris
atgcaaaagaagaaggaaatattggagagggcaaacaataaaccgaattacagcattacacatgatatgacgaatatatataccgaagcattttccattttctttaaaatcggtgcattcaccattggcggcggctatgccatggttccattgattgaggacgaaatcgtaacgaaacgccggtggatagccaaagaggattttatagacctgcttgccatcgcccagtcggcaccgggcatccttgcggtcaacatatccatattcataggctaccgcctgcgtggaatacggggaagcatcgttaccgccctgggaacgatactgccttctttcctcattatccttgccatagccttgtttttccataacttcaaagacaatgtctacgtagagcgtatcttcaagggtatccgtccggcagttgtagcactgatagccgctccgactttcagtatggccaaatccgccaaaatcaaccgctacacgatatggattcctattgtctcggctctgcttatctggttattgggcttctcccccatctggattatcattgctgccggtataggcggatacctgttcggaaggctgcgcttcccgaaaaccaacagttaa

SEQ ID NO: 2958 - DNA, 567 bp, Bacteroides stercoris
ttaatttcatacatttgcagcctatacaaagaattatcattcaaaataaatagtaaatattatgttaaaaaaatcgcactgctcgtagttatgtttgccctccctctgggagctatggcgcaaactaaattcgctcacatgaactctcaagaagtaattgtcaccatgccggaatacacaaaagcacaagccgacctggatgctatgtctaaagagtatcaaacagaaatgcaacgtacccaggaagagttcaataagaaatatcaggaattcttggcacaagccgactcacttccgaaaaacattgcagaaagacgtcagaaagaactgcaggacatggcacaacgccaagaacagttccagcaggaagcatatcagtctatgcaaaaggcacagcaggatgccatgactcctatctataaaaagctggacgaagctatccaggctgtaggtaaggctgagggtgtagtatatatcttcgacctggcccgtactccgataccttatgtaggtgcacagagtgtagatgtaactgccaaagttaaaacgcaactcggcattaaataa

SEQ ID NO: 2959 - DNA, 699 bp, Bacteroides stercoris
tacgcaaaatcggcatttaaaaaggcttatacgtgttttttatctatttttgcagacatgaaaacgcttactgatacccaatatatacatgctctcatagccgaaggagagcaccaacaacaagattttaagttcgaaatatctgatgcgcgaaaaattgccaagacgctttctgccttttcaaatacggacggcggacggcttctcatcggcgtaaaggataatggtaagattgccggagtgcgttccgatgaagaacaatatatgatagaggcagcagcccggttatactgccggccggaagtgagttacagcacacagacctatcaggtagaaggccgcagcgtattgctggtgcaaatcgatgaaagcgaccgtaaaccggtatatgccaaggacgaagccggcaaatatcttgcctatctgcgcatcaaggacgagaacatacttgccaccccggtacatctgcgtatctggcaacaaagcaaaagtcctcaaggagaattgatggaatataccgaacgggagcagctactgcttgatttactggaacaaaacgaccggttgtcactgaaccgttattgccgtctggcacgtctgtcacgccgtgctgcagagcatctacttgccaaactcatccgttatgacattgtggaacccgtattcgaagggcataagtttcacttcaagctgaaataa

SEQ ID NO: 2960 - DNA, 915 bp, Bacteroides stercoris
gtggcaaaagaaagaattatagcaagagcccgcacgcaatatacggactatatggtaaaagagcctatggaactgatggaatttctggcagcgaaaatgccggatgccagccgcaccaagctgaaagcattgctgagcaagcgggttgtatatgtagacagcgtcatcacaacgcagtacaacttcccgctgaagccgggtatgaaagtccagatcagccgtgagaagggacgcaaggagttcaacaacaaattactgaaaatcgtatacgaagatgcttacctcatcgtggtggagaagatgcagggattgctgtccgtcaatacggaaaggcagaaagagcgtaccgcctacaccattctgaacgaatatgtgcagcgttcgggcaggcagcaccgcgtgtacatcgtgcatcgcctggaccgcgacacctcgggactgctgatgtttgccaaagacgaaaagacgcagaatacgctgcgcgacaactggcacaacatcgtaaccgaccgccgctatgtagccgtcgttgcgggtgaaatggaaaacaatgccggcatggtgcgctcatggctcaccgaccgcaaactgtacgtatattccagccccacggacgatggcggcaaggaagcaatcacccactaccgcaccatcaaacgcgccaacggcttctcgctcgtggaactgatgctggagacgggacgcaaaaaccaaatccgcgtgcacatgcaggatctgggacatcccatcattggcgacggacgctacggactggaagagataaatcctatcggacgactggcgctgcacgccttcaagctgtgcttccgccaccctgtcaccggagagctgatgcagtttgaaacaccgtatccgggagagttcaagaaactgtttctgaaacgtaatggataa

SEQ ID NO: 2961 - DNA, 483 bp, Bacteroides stercoris
tttaaattaaaaaaagttatggcattgaattacgaagtgaaaaagaaagtattcggttttgatcagacaaaaacggaaaagtatgtagcgcaactgaaaacgcttggtataatacagtttggcgatttgtgcgatgaagtcaccaagataggcatggccccgcgtggtgtggtaaagatggttctggatggcttgatagacacattgaacattaacattaacaagggattttccgtacagttgggtgatttcggttgtttccgaccgggcatcaatgcaaagagtcaggacagggaagaggatgtgaagtcggatacggtttatcgtcggaaaataatttttacaccgggacagtacttcagggagatgctgacacgtgccagcgtgacgagagcaagttgggaaaaaacggaaactgtttcgggaagcggttctgctccgggaaccggcggaaacggggaagaagaaaatccgttgggataa

SEQ ID NO: 2962 - DNA, 1311 bp, Bacteroides stercoris
atgaatatcggttcggggatgcttttggacaggaccattcagcctaaggtgagggacattgagcacttggccgtacagatgccccaacggtgcactatgcccaatggtgtgtctttgaatgtgcttgactctggcgataatgaagttgtgcgcatagacctgctgatggaaggcgggcgttggcaacagtcgcaaccgttgcaggctttgtttacgaaccgtatgctgcgcgaagggacgcttcggtacagtgcgggggaaatagcggagaagttggactattacggtgcctggctggaattgtccagcgcatcggaatatgcgtatattactctttattcgctgaacaaatatttgccgcagacgttggaaatactggaatccatcgtaaaagagcctgtgtttccggagaaggagctgggtgttataatagaaaataatatccagcagttcatggtcaactcgtccaaagtggattttctggcgcatcgggcgctgatgaaagctgtatatggtgaggtgcatccttgcggacggctggtgcagaaagaggattatggcaggataaatcctgctgtactcagagagttttacgaccggcattatcattcccggaactgcacgatttacgtttccggaaaggtgagcgatgattgtgtacggcggatagaagatatgtttggtaaggaagtgttcggcaaagacttccgcaaaccggaaaggcgggagtttattccggtttcttccatggataaacgaatttttgtagaacatgcggatgccatgcagagtgcggttcgcatggggatgctttctttggaacgccatcatcccgattatttgaagaccagagtgatggtaacgctgtttggcggatatttcggaagccgtctgatgtccaatatccgtgaagaaaagggatatacctatggcatttctgcaggcatcgtttcttgtccgggaccggaaatgctggttatcaatacggaaacggcaaacgagtttgtggagcctcttatccgggaggtttaccatgaaatagattgcctgcagaatgatctggtgccggaagaagaattggcaatggtaaagaattatatgctgggcgaaatgtgccgcagttatgaatcggcattctcactggcagatgcgtggatgttcgttcaggtttcgggttttggcgatgcacactttgaagatgctctgaacgcagtcagagatattactcctgaagatatacgcgaacttgccggaaagcatttgtgcaaagagaaattaaaagaagtcatatccggcaaaaaaatgtcataa

SEQ ID NO: 2963 - DNA, 1158 bp, Bacteroides stercoris
aagacatttgtccctttttattcgtcttttccagagattttccgtatctttgtatcggtagttggcaaggtaatgaccgaacgtaagattatacatattgatatggacgctttctatgcttccgtagaacagcgcgacaatccggaactgcgtggcaaacccgtagcggtggggcatgcggaagagcgtggtgtggtagctgccgccagctatgaagcccgtcggttcggggtgcgttcggcaatgtcgtcacagaaggcaaaacggctgtgtccgcagcttatttttattccgggacgtatggacgtctataaatcggtgtcccgtcaaattcatgagatattccatgaatatacggatgtcatagaacctatctctttggatgaggcgtttctggatgtgacggaaaataagccgggtattcttctggctgtggatatagccagagaaataaaacggaaagtgcgcgagcagctgagtctggtggcctctgccggagtttcctacaataagtttcttgccaagatagcatccgattaccgtaaacccgacggtttgtgtaccattcatcccgaccaggctttggaatttatagcacatctgccgatagagagtttctggggagtgggtccggtgacggcaaggaagatgcatgttttggggatacataccggcgggcaactgcgtgcctgttcgcaagcgatgctgttgcgcgagtttggtaaggtgggaaacatctattatgattttgcgcgcgggatagatcttcgtcctgtagaagcggtgcgcattcgtaagtctgtggggtgtgaacatactttggagaaggatattaaccggcggtcgtcggtcattatcgagttgtatcatactgcggtggaactggtaacccgtctggaacataagaacttccgggggaatacgctgacgctgaaaattaagtttcacgatttcagccagataacccgcagcgttacgcagtccaaggaattgacggcacttgatgtgatcctgccgttggcgaaacaactgttgagggaggttgattacgaacatcatcctatccgtctgataggcctttccgtatccaaccctcgtgaagaaagtgatgaaaaaggtgtttgggaacagctgagttttgaatttagtgactggtaa

SEQ ID NO: 2964 - DNA, 642 bp, Bacteroides stercoris
tcttatagaacaaatatctccttcattatgactgtcaagataggtataaccggtggtatcggcagtggaaaaagtgttgtgtcccgactgttggaggtgatgggaatcccggtctatatttctgatggggaaaccaaacagcttatgatgacagactcttgtattcgcagtgagttgactgccttgttgggtgaggaggtgtatgccggtggagtattgaataagtctctgcttgcgtcttatcttttcggtagtcccgagcatgccgggcagattaatggtattgttcatccgcgtgtaaaagaggatttcaggcagtgggtttgtcagcgtgcggcatgccggatggcaggaatcgagtctgctattctgatagaggctggatttgcagatgaggttgatgtagttgttatggtctacgctcccgaggagatacgggtgcagcgtgccatgaagcgggatgcttcctcacgtgaactgatagaaaagcgcattcgtagtcagatgggcgatgaagaaaaacggaaactggcagattttgtgatagtgaatgatggcgaaacaccgttaattccgcaggttttgggcttaatcacttttctgtctcaaaataatacctatctttgcccaccgaaaaaatga

SEQ ID NO: 2965 - DNA, 654 bp, Bacteroides stercoris
gtgaataaagaagcagcattggtcgtattcagcggtgggcaggattcgacaacttgcctgttttgggcaaagcgtgagttcaggaaagtatatgcgttgagctttctgtatgggcagaagcatcagaaggaagtggaactggcacgggagatagcgcgtaaagcggaagtggagtttgaagtaatggatgtttccttcatcggcaagttggggcataattcgttgacggaccccgatatggtgatggaccgggagaagccggcagacagtgttccgaatacctttgtgccggggcgcaacctgttcttcctcagcattgccgccgtctatgcccgcgaaaagggtatcaaccacatcgtgacgggtgtgtcgcaaacggatttcagcgggtatcccgattgcagggacgcatttatcaaatcgctcaacgtaacgctcaaccttgccatggacgagcagttcgtactccatactccgttgatgtggattgacaaagccgagacttgggcgctggcggatgaactgggagtgctcgacctgattcgtcatgagacgctgacctgttacaacggcatccccggcgacggctgcggacactgccccgcatgcaagctccgcagagaggggctggagaagtatctggcgggaaaatga

SEQ ID NO: 2966 - DNA, 567 bp, Bacteroides stercoris
gaaatgatagaagacattaaaaaagcctgccaggtaatgagggaaggcggggtgattctgtaccccaccgataccatttggggtattggttgtgacgctaccaatgaagatgcggtgcgccgtgtatatgaaataaagcagcgtcaggacagcaaagcgatgctggtgttggtggattcttccgtaaaagtggatttctatgtccgggatgttccggaggtggcgtgggatttgatagacctggcagacaaaccgttgactattatttattcgggagcgcgtaatctggcggcaaatttgctggcggaagacggaagcgtgggcatcagagtgacaaatgaagatttctccaagcgtctttgccagcagttccgtaaggcgattgtttctacttcagccaatatcagcgggcagccttcgccgaagaacttcagcgaaataagtgaggaggtaaagtcagcggtggattatatcgtaggctaccggcaggaagagatgagtaatccgaagccgtccagcattatcaagttggataaaggcggagtgattaaaataatccgtgaataa

SEQ ID NO: 2967 - DNA, 573 bp, Bacteroides stercoris
aaagttaataatatgatatatagatttaccctcatctccgatgaagcggacgacttcatcagagaaatacagattgacccggaagccacgttctatgattttcacgaagccatcgtgaaatcagtaggttataccgacgaccagatgacctctttcttcatctgcgacgatgattgggaaaaggaaaaagaagttaccctcgaagaaatggacgacaatccggaaatagacagttgggtgatgaaagacactcaggtcagcgaattggtagaggacgaaaagcagaaactcctgtacgtgttcgactacatgacagaacgttgtttcttcatcgaactctccgaaatcatcaccggcaagaatatgaccggagcaaaatgcaccaagaaagccggagaggctcccaagcagaccgttgactttgaagaaatggctgctgccagcggctcgctcgacttggacgaaagtttctacggcgaccaggacttcgacatggaagacttcgataaagaaggattcggcggtttggacgatggaaccgcaggtattgcttacgaagacgacaaattctga

SEQ ID NO: 2968 - DNA, 651 bp, Bacteroides stercoris
atgaaacctataatatccccttccatattgtctgccaactttgcatacctggcaaatgatattgaaatgattaacggtagtgaagccgactgggtacacgtcgatataatggacggcgtgtttgttcccaacatatctttcggttttccggtattgaagtatgtggcaaagcttgccgagaagcctttggatgtgcatctgatgattgtacagccggaaaagttcattccggaagtaaaggcgttgggggcacgtataatgaacgtgcattatgaggcatgcccacatttgcatagggtagtgcagcaaatccgcgaagcgggaatgttgccggcggttactatcaatccggctactccggtatctatgctgagagatattatcaacgatgtctatatggtgttgataatgggggtgaatccgggattcggcggtcagaaatttatagaacatactgttgataaggtacgtgagttacgcgaactgatcacagtgaccggttcggaagccctgatagaggtcgacggcggtgtcaatctggatacaggctcccgtctggtagatgcaggagccgatgccttggttgccggcaatgccgtattttctgctcccgaccctacagaagcaatccgtgctttgaaaaatctgtaa

SEQ ID NO: 2969 - DNA, 528 bp, Bacteroides stercoris
atggtatgtattgaaactccccgtttgatattgcgcgattggaaagaagaagacttcattccttttgcagagatgaacgggaatccgtctgtcatggagttctttctgcatcctttgtccggggaagagtcccgcaatctttttgatactgtcaggaacgagtttcttcagtacggatatggcggatatgccattgagcaaaagtccgatggagcctttgtgggttttacgggttttcataactttatgtttgatgtggactttgctccgggtattgagatactgtggcgattaaggcaggaatattggggtcggggatatgctaccgaagcagcgaagtcatgtctggcttatgccaaggagaatcttccgttttctatggtccgggcttttacttcgctgaccaataaacattcgcaacgggtgatgcagaagatagggatggaatttgaaaagaattttatgcacccagcagtgcccgacgggcatctgctgaaagagcacgtactctataagatacaattgtaa

SEQ ID NO: 2970 - DNA, 576 bp, Bacteroides stercoris
aaagcatacatcggcaaaatagttaacttcttggaaagaataaggatgagtacaatcaattacgatttgaataagataaaagccctcgcctttgatgtggacggggtgttgagcgccaatgtcattccgatgagtacggaaggcgagccgctgcgtacggtaaacataaaggatggctatgccttgcatctggctgccagacatgaaataccattggctatcattaccggtggacgcacggaagcggtgcgcaagcgtttccttgctttgggattattgccggagaatatctatatggggtcttccgtcaagatacacgattatcgcgacttccgcgaccgctacggtctgcgggatgaagaaattctatatgtaggtgatgatattcccgatattgaggtgatgcgcacttgcggtttgccttgctgtccgcgggatgccgctcctgaggtaaaatccgttgcccgctacatctcccacaaagaggggggatacggttgcggacgggatatcgtggagcagttcctgaaagtgaaaggcctttggatggcagacgagcgagccttcggttggtaa

SEQ ID NO: 2971 - DNA, 711 bp, Bacteroides stercoris
atgccgaatccttattttcagttcaaacaatttaccgtccgacacgacaaatgcgccatgaaggtaggtacagacggggtgttattaggagcgtgggctccggttcaagatgttaaacgaattcttgatgtaggagcgggtagtggcttaatatccttacaattagcacagcgtaatccagaagcggtaattacctctgtcgagatagatccggcagcggcggcacaagcccaagagaatattcaatcgtccccctggagcaatcggatggaagttgtatgctgcgacttccgcaagtatcacccggaagataaattcgacctgattgtttccaacccgccttattttgttgacgccctgagatgccctgacaatcagcgctgcatggcacggcacacgagtgagctgaactatgaacttcttttggggcattcggcgcacttattatcggaacagggggttataagcattatcattccggccgaagttgaaagaacagtgattgatacggcctggaaatataattttcatccacatcgccgtttgcatgtttttaccaaacccggaaaaccttgccggcgcgtgttgctgactttcggccgacaaagcatatcatgtattgaggacagtctttacatagaaggagagaaacacgaacaatttaccccagagtacattgcgctgaccaaagacttttatttaaagatgtaa

SEQ ID NO: 2972 - DNA, 630 bp, Bacteroides stercoris
atgttagtcgatttaacagtcaaagagtttttgaataaagtggcgggcagcgatcccgtccccggcggcggaagcatcgccgcattgaatggagccgtcgcttcggctttggcggcaatggttgccaacctcactatcggcaagaaaggctatgaggagcatgaagaactgatgaaacatatctccgaagtggctttgcaagtgaaagataccttcatcggcgacatagaccgcgactccgaggcctacgacagcgtatttgcctgcttcaagatgccgaaggccaccgatgaggaaaaggccgcccgcagcgcagccattcaggaagctacgaagtttgccgcacttgtgcctatgcaggtggcgcgcaatgccttcgaactgatgaccgtcattatggacgtagcccgcctgggcaaccgcaatgccgtaaccgatgcctgcgtggcaatgatgtcggcccgctctgccgtgttgggagccttgatgaatgtgcgcatcaacctcggttcgctgaaggataaggagttcgttgccaaactgcaagccgaagccgatgaactggaacgccttgcctgcgccaaagaaaaagaattgttggacgaaatcaatgaggagctcaaagtatga

SEQ ID NO: 2973 - DNA, 633 bp, Bacteroides stercoris
atgaaccgtatgttacttgcgctaaagcgcccttttatctggctgtaccgattccgccaccgttgcggttacggggtgcactcgccttttgccttcaacctgataacgcacgttatctatgaaactactccttattataagtataaggagctggcttccgagcagaagaggcttatgccgcagaaagaccgggcatgggggtacgagtccttaaaggtgaaacggcttctgttccggctggtaaattatgcacagccggctacgattgtggatgcaggcatgcaggctgcctcttccttatatctgaaagctgcgaaggaaggggcggactacactgctgccgccgacctgtccgaactgtttctggagagtggcgcgtctgtcgactttttatacctgcacgattaccgccgtccggagtttgtggaagaggtgttccgtatctgtgccgaccgcactgcgcaaacgtccgtctttgtaatcgaaggtatccgttatacttcccggatgcgtgccgtttggaggcgtatcagccggcacgaaaaggcaggcatcactttcgacctttacgatctcggtattattttctttgataaaaccaggataaaacaagactatattgtcaacttttga

SEQ ID NO: 2974 - DNA, 894 bp, Bacteroides stercoris
atgatacagactaaattgaaaggaatgggggtagcgctgattactccatttaaagaggatgaaagcgttgattacgatgcattgatgcgtttagtagactatcagctccaaaacaacactgattttttatgcgtacttggcactacagcagaaactccgacgctggctgaagaagaaaaaaagaaaatcaagaaaatggttatcgagcgcgtgaatgggaaaatacctattctgcttggagtaggtggaaataacactcgcgctatagtagaaactctgaagaatgacgattttaccggagtggatgccattctttctgttgttccttattataacaagccttcccaagaagggatttatcagcattataaagcgatttccgaggctatcgaccttccgattgtactttataatgtaccgggacgtaccggagtaaatatgaaagccgaaacaaccttgcgcatcgcacgcgactttaagaatgtaatagcaattaaagaagcatcgggagatatcagccagatggatgacatcataaaaaataaacccgccaattttgacgttatttcaggcgatgacggcattaccttccctctgattaccttaggagccgttggtatcatctcggtcataggaaatgcctttccgcgtgaatttagtcgtatggtacgtctggcattgcaaggagattactcaaatgcgctgaccatccaccacaaatttgcagaattattcaaattactctttgtagacggtaatccagccggagtaaaagccatgttgaatgcaatgggaatgattgagaacaaacttcgcctaccattagtgcctaccagaatcacgacttttgaagcaatgcggaagatattggatgaattgaatattaaatgctga

SEQ ID NO: 2975 - DNA, 510 bp, Bacteroides stercoris
aataattattcacttaaaaacgaaaacaagatgagaagacttgcattgatcgtatgcctgcttattggcacagtggctgcccacgcgcagtttgaaaaaggaaagtggttcgtcaacccttccgttaccggacttaatttttcctacaatacggaaacggataaggctcatttcggtcttgaggtcaagggcggtgcttttttaatcgataacgtggctttgctgctggatgccggcgctacatggcaaggcggcggaacggatgtctatacgttgggtgtgggcggacgttactatttcaacaaaattggtgtatttctgggagctgatgtaaacttgaaccgttacaactgggacggtggcgataaaacccgtttcggcttcggcatggagggcggttatgctttcttcctgtcgcgtacggtcactatcgagcctgccgtttattgggatataaataaagaccgttcggagttcggtctgaaagtgggattcggtttctacttctaa

SEQ ID NO: 2976 - DNA, 2520 bp, Clostridium sp.
atggacgaaaatatctttgacaaagttcatgaggtggacttaaaaaagacaatggagacatcctatattgattatgccatgtccgttattgcagcaagagcacttcctgatgtaagagacggtttaaagccggtacaaagaagaatcttatatgcaatgatcgaattaaataatggtccggataagccacatcgtaaatgtgcccgtatcgttggtgataccatgggtaaatatcatccacatggtgacagctctatttatggtgcattggtaaaccttgcacaggaatggtctacacgatatccgttggtcgatggtcatggaaactttggttctgtcgatggtgatggagctgctgcgatgcgttataccgaagcaagattaagtaagatttcaatggaaatgcttcgtgatatcaacaaagatacagtagattttataccaaactttgatgagacagaaaaggaacctgttgtattaccatctcgttttccaaatcttttagtaaatggtacatccggtattgcggtaggcatggcaacgaatattccaccacacaatcttcgtgaagtgatcaatggtgttgtacgtctgatcgatgatattgaagaagataaagaaacaacaatggaagaaattcttggaattatcaaaggacctgacttcccgaccggagcacagatcttaggtacaagaggaattgaagaagcatatcgtacaggacgcggaaagatcagagtgcgtgctgtgacagagattgagccaatggataacggtaagaacagaattgtagttactgagcttccgtatatggtcaataaagcaagactgatcgagaaaatagcagaattacataaagataaaaaggtcgatggactgacagatatacgcgatgaaacgagccgtgaaggaatgcgtatctgtatcgaactgcgtcgtgatgtcaatccgaatatcgtattaaatcagctatacaagcatacccagcttcaggatacgtttggtgttatcatgctggcattagtcaacaatgagccggtcgttatgaaccttttacagatgttaaaatattatctgatgcatcaggaagaggttgtaacacgtcgtacaaaatacgatttaaataaagccgaagagagggcacatatcttagaaggcttattggttgcattagataacattgatgaagtgatccagatcatccgtggatcaaagaatgccaatgaagcgaaagaaaaattacagcagagattttctttatcagaggcacaggcaaatgcaatcgtagaaatgcgtttgcgtgcattgaccggtttggaaagagaaaaactggagagtgaatatgcagaattagaaaagaaaattgccgaatacaaagcaatcttagcagacagaaaagtattgctttctgttgtaaaaaaagaaatcattgagatcagagacaagtatggtgacgaaagacgtacttcgatcggatatgatgagtacgatctttcgatggaagatctgattccaaatgaaaatacgatcattacgatgacaaagctcggttatattaagagaatgactctggacaattttaagagccaacatcgtggaggcaaaggaatcaagggaatgcaaacgatagaagatgattatatagaagatctctttatggcaaccacacatcattatctgatgttctttaccaataagggaagagtatatcgtctgaaagcatacgaaattccggaggcaagcagaacagccagaggtactgcaatcattaacctgttacagttattgccggatgaaaagatcaccgcagttattccaatcagggaatatcaggatcagaagtatctgtttatggcaacgaaaaagggaattgttaagaagacatcaattgtagaatatgccaatatcagaaagacaggacttcaggcaatcagtcttcgtgatgaagatgaattgattgaagtaaaagtaacaaacaagaagaaagatattattttgatcacgaaacatggtcagtgtatccgtttcaatgaaaatgatgtaagacctacgggacgtacttctatgggtgtgatcggtatgaatctttcttatgatgatgaactgatcggcatgcagcttaatacgcaaggagactgtctgatgatcgtatcagaatatggtatgggcaaaaagacagatatcaatgagtttggcgtacagcatcgtggcggtaaaggtgtgaaatgctataagatcacggataagaccggaaatgttgtaaatgcaaaagctgttaatgacgataatgaagtaatgcttattacaacagaaggcatcatcatccagttaaaagtatcagaaatatcaacacttggacgtattacatcaggtgtcaaactgatcgatctggatcctgaaaaagatattgttgtagcaagtatggcaaaagtcagagatgcgattccggaagaaaacggtaattcagaagaaaaattattagaagaattgcaaaaagaaatggatgaagaagaaaaataa

SEQ ID NO: 2977 - DNA, 1581 bp, Clostridium sp.
atggtaaatttgcctgaaaaatattgtgaaaatatgaaagaactattgcaagaagaatatacagactatatagatagtctgtcagaaaaaacatatcaggcgatacgcatcaataccaagaaaatatcgttacagcaatgggaaaagatcaatccttttcggacaagtccgatcccatgggtggaaaatggattttatattgaagatgcaatggaatatggacagaatgaatcaggtcaacaggagagtccgataccatccagacatccttattattatgccggtttatattatattcaggaaccgagtgcgatgattccggcaagtctgcttccggtaacacccggagataaagtgttagatctttgcgcggcaccggggggaaaagcaacggagcttggtgcaaagttacagggacatggactgctggtagcaaatgatatcagtgtatcaagaactatggcattagccaaaaacctgcagatcgcaggtattcaaaattgtcttgtgacagcagaaacaccggagaagcttgcttctgtttttacaaacttttttgataaagtgttgatcgatgcaccatgttccggagaggggatgtttcgaagagagccgcgtatggttcatgattgggaagagaaaggaccggcatactatgctaagatacaaaaagaaattttgacacaggcatatcagatgttaaaacccggtggaaaaatggtatattctacttgtacattttctttgcaggaagacgaggctgtgatcgaatggttcttagacatatatcaggatatgaaagtgtgcccggtggaacgaaaagaaggctttttgccgggaagaccggagaggatcgcagcaagagaggaattaaagcattgtgtcaggatctttccgcataaagcaaaaggggaaggacattttgctgtacttttgcaaaagggagattctgtggcagatgcagaagaaacgcagcgcagcagggaaagtctgacaaaagagcataaaaagcaattagaagattcgatagaagatcttacgatcacaatagaggacagatcgcaaaaaggcagtttttctaagaaaaaagaatatcagcgtaacaagtctgataagaaaaaaggaaaatcaggaagggagaaattcgaaaaagcatcacaagggcagacagtgcaaaaagcagatatgcagacaaaagagtttttagctcatcttccgtttgaagaaggaagatatgtttcacacaataatcagatttcttttgagcctttgtggatcgaatcgctttctaagctgcggattgtgcataaaggtgtagcagtctgtgaaataaagcaaaaaacagtattatcccatcagctggcgttgtgtttgagggatgaagattttgatcaggtgatcaattttcaggcagccgatccacaggtgatccgttacctgaaaggagaaagcatacagacaggtatggcgtatcgaggcaatgtattggtctgtgttgatggatttggcttgggctggtgccagggcagcggtaccacattattgaaaaataaatattatccgggatggcgttaccaatag

SEQ ID NO: 2978 - DNA, 2226 bp, Clostridium sp.
atgaagaacaagaaaaaggggttattgcaaattattctgatccttgcaataatcggtctctgtggcttcacaactttagttggctttacaaagcaccataaaggtagcgcacagaacatcaagcttggtctggatcttgccggtggtgtcagtattacatatgaagctgtcggagatacaccttctcagaccgagatggaagatactcgtaacatgatgcagaaacgtgccgaggtatatagtacagaatcttctgtagtaattggtgatggcggacgtatcacaattgacattcctggtgttgcaaatgcagatgaggtacttgcatcattaggtaaagaaggatctcttgactttgtagctcaggatgatatgtcatttgaagataatgatcagacaaagcccaaatatacaaagacagtttgtaccggtaaagacgtaaagactgcagaagctacgacacagcagaatgaagtaacaaagaagaaagaatatgtcgtatctttgaagtttaagtcaaaaggcacaaagtcatttgcaaatgcgactgcagcagcagctccatcaaataaggtcatttatattgtatatgatggtaaggtgatttcttctccggctgtacagagtgagatttcgaacggagaggctgttatctcgggaagttttaaaacatatgatagtgcggaagaacttgcttctatgatccgaatcggtgctctccctgtagaattaaaagaagtacagtcgcaagtagtaggtgcacagctcggacaggatgcaatccagtcaagcttgcttgccggtgcgatcggttttgcattggttgtgctgtttatgattgtattttaccgtttgccgggtcttgcagcttctattgcgttggtgttctatctggtagtgatgctggtaggcttaaatgcattagatattaccttaacccttccgggtgtggcaggtatcatactgaatatcggtatggcagtcgatgcgaacgttattatctttacacgtattaaggaagagctggctaagggcaagacagtacaatcaagtattaagcttggttttgataaagcgttatcagctatcgttgatggtaacgtaacaaccctgatcgctgcgtttgtgttatatattaaaggttccggtacagtaaaaggtttcgcgacaacattagcgatcggtattattttatcaatgtttaccgctctttacattacaaagattcttttgaaggcaatgtatgcattgggtgtagacgatattaaatactttggtgttgaaaaagaaagaaagacgattcactttgttgaaaataaagtgaaattctttgtgatttccggcgctttaattgtagcttgtgtggtttgcctgtttattaacaaggcaggaagatgcaacggaaatatcctgaattatggtctggatttctccggtggtacaacatttgatatcacatttaacaaagatcagaagattgactctgatatgaagaaagatattgaatcagtatttagtaaggaaagcggttcgaatgatgttgtcatttcagaaattgccggttcaaacggtctttctgtaaagacagtcgaattatcagagaagaaacgtgatgcattaacaaagtcattagttaagacatatagtgtagaagaaaagaatatccagtatcagaatatcagtgcttcggtatcggatgaaatgaagacggatgcaattgtagcagttgtgatcgctgcaatctgtatgctgatttatatctggttccgttttaaggatatcgtatttgccggtagtgcggtattggcattacttcacgatgcagtagttgtattattggtatatgcagtatctaagatttctgtgggtaatacatttatcgcttgtatgcttacgatcgtaggttattcgatcaatgcaacaatcgttatctttgaccgtatccgtgagaaccttggttcaaagacaagtgaagaagctcttacagaggtcgtaaaccagagtattacacagacgttaacacgtagtatcaatacttcattaacaacattctttatggtaatcatgcttgcaatcttaggcgtggattctgtaaaagactttgcaattccattgttagtgggtattatctgcggtggttattcttctgtatgtatcaccggtccattgtggcttacaattaagaaacgtgttcatacaggaaaaggaaagaaagcaagaaaatag

SEQ ID NO: 2979 - DNA, 2997 bp, Clostridium sp.
atgaaatacgcagcatttataagctaccgccatggtgggattgatgaaaaagtaggtatgcagatacagcacgatctggaacgatataagataccttcaaagattgcaaagagtattgggaaaaaaagtcttggtaaagtctttcgtgacgcagatgatctgcgtgcagccagcgatttatcggcaatcatacgtgccggaattgatgaatcggaatatctgatcgtgatctgtacgaaacgatatcagaaatccgtctggtgtatggaagagattgaatatttcttagaaacacgcgacagagaacatattattgttgttttagtcgaaggagaacctcaggaaagctttcctgaaatcctgacgcatatcgagcgtgacggtaagatcgtagcgattgaaccgttggcggttgatgtccgtgccgaaacggaaaagcagatcctaaaaaatgtaacaaaagaaaagcttcgctatatctcacagatgttagatatggattacgatgatctaaagcagcgccagaaagaacgtcaaagaaagagaaatgcaattcttgccggtattgtttttgccggtgttgctgtctttgcaagtgtagtatcttataagaatgtacagttaaatactgcatatgacagtctggatcattcgatgcagcagacattaaaaggacaatcttactatctgtcggaatactcaaataccgcctatcttaatggagacagggcaaccgcagcacttctggcactgaaagcactgcctaagaatcttgaagaaccggacaggccttttgtgccaagtgtaatgcggtctttgtcatcagctctgggagtctatgatttcagcagcggctatcagccggacaaggtgtatgattttaatacagaagcctatcatacgaaagtaacgatcagtaagaaaggaacgtatctggtcattgaacgttatcaggcagcagctaataacatgttgaatggaaaagcctatatttaccggattgataaccgtaagctggtacagtgtgtcaatctggatgacatcagtaaaacagcgatacatacctcttcacatatggcttgtcttacaaatgatgaaaagatattttattatcttggaaaagacggactttgtgccatggatctaaagagcggtaaagagctttttaccgggcagaaaggctgtcagatggtattgagtgagcaaaatgatgtgatttctgtttatgatgatgatacggcaacgttatattcttatgctacagatggcagattacaggcacagacagctttatccgcacagaaaaaatatgcattatattgtatcagtcctgacagcagcattgcggttctgtcacaggatgctaaagacggtgtcggaatcttacttgctgacacgtcgaatggcggtacactttttgcagacaaaagcgaaagctgcagtcagatatcctttattaatgatcacagcttatgttttgtgcggcaggatacacagatggggaagagtcatatcgttgtttatgatctgaatgaaaacgcagatgattacctcgtagattccgaacgaagcagcattggaacgattgccatgtcaggcaatgaaacctgctttttctatgtcgataaagacgtttgtgaagtcagcaacaagaccggaaaagtgatttggaaaaatacatattcttccgatgtgacttctgtgaaagcacagggcaattatttaatggttacactcaaaaacggacagagttatttttataacagcaaaaaacatctgttgatcaaccagtctgccggaaatgaagaaaatttctatgcaatggcgttaaatgaagattatgcctgtagtgcggatttttgggggaagaatattcgtttatacagcaataaaaagaagacaagaaaagacgtgacaacaaaagagattataacaaataccacacaacgtcctgaaaagtggtatactgcttcatcaaatggaaagacaatcctgctggattttaaaaatggaatgcaggataccgtaaaggcattccgtgcggatacacttgagatgattggcagtacaacattaaaggatatggattatgagtcctttaataatctttctgtttctgcggaaaatgacaaatatatcagcattcaggattacgcctatggagcaaatgctcattttaatgcaaaaacgatgaaaaaagtattttcttatgatgaagattcgtattatttctataatgatgaccgttctctgatcacgattgcacaaaaaaatgagttagtgacctatgatgcggcgacaggaaaagtcaaaaagaaaacagcgattccggatgcctatgaccgtggattgcaagtcggagactatacgatctttggaaatgataagaaaatagcaattcggaaaaaagggaaaaaagacgtgatcttaaaagatgccgtgatctatacttcaaatgaaaagcaaaagctgctatgttatcgcagcgtggatgcaggcaaatggtatgtctattcgttagaaaagggaaaaatcatcagtcagggaaaagcaggaacatttgcgtgtacgatcttttttgatgatggaacttattttctgaatgattataatgccgtttatgatgcacaatcagggaaaaaagttctggatttatccgatatcagcaccggagtatatggagtatatacgaataaaaagattccgtattttgttgtatggtatcaaagcggagaatccgatgcaaatggtaaatccagcggaagtaacatggcatatctgtataacaaaaagcatccggaagagattgttgcaagtattccgaattttgtggcaatggcagaagatggcagcgtgatcacatttgacggagatcatacattatataaaacaccattatattctgaaaaggaactgttacagaaaggaaatgaatttgttaaaggtatgaagcttacaaaagagcagaaagaaaagtatcatttgtttacagaataa

SEQ ID NO: 2980 - DNA, 1938 bp, Clostridium sp.
atggaagagaacaactcttttaaaccttatgtcagtgcagacaaggtattgccggaatttacggtttcatcgattctgatcggtattatccttgcgattgtctttggtgcagccaatgcatatcttggacttcgtgtaggtatgacagtttctgcatctattccagcagccgttattggtatgggtgtgtacaagctgctcggtggtttttcttcgaaaaaagaagaaacgattctggaaagcaatatggtacagacaattggttcagccggtgagtctttagcagccggtgctatttttaccatgcctgttctttttctgtgggcagcagaaaagaaggcacagatgcctagcattgtagagattgcattgatcgcaatgatcggtggacttcttggtatctgctttatggtacctttgcgtaaagcattgatcgtaaaagaacatggaacactgccttatccggaaggaactgcttgtgctgaagtgctgcttgcaggtcaggaaggtggcgcaaatgcagcaatcgtatttatcggaatgggaatttctgcattagttaaatttatcgtagatggattgaaagtagtatcaaatgttgtaacgatctctattcagaagattcatacagaagtcagtgcagaagtgtatccggcattgatcagtgttggttatatctgtggttttaagattgcatcttatatgtttgccggtgcgatcctcggatggcttgtattgatcccggcaatctatctgtttggtgcaaataccattttatatcctgcgacagtaacgatcgcagaagtatggaagagtagtggggcatccggtatctggtcaaattatattcgttatatcggtgccggtgctgtagcggccggtggtattatcagtcttgtgaaatcacttcctctgatctgccgtacatttgtagatgcacttcgcggaatgatgaacaaagaagcaattggtaaagaagaacgtactaaccgtgatatgaatatgggacttgttctgggaatgcttgctgtattgatcattctgatcgcagtattacctgttattccaatcggtgtcttaggagcaattattattgttatctttggtttcttctttgcagccgtttcttcaagaatggtaggtttagtcggcagcagtaacaacccggtatcaggaatggcgattgcaacattgctgatcacaagtctgatcttaaaagcaaccggtaattcaggcgcatcaggaatggttgcggcgatcgcaatcggttctgttatctgtattgtggcagcaatggccggcgatatgtctcaggatcttaagacaggttatatccttggagctacaccggtaaaacagcagtatggtgaattgataggtgctgttgtatccgctattacgatcggctttgttctttatcttttaaatagtgcatggggatttggaacacctgcacttgcagctcctcaggctactttgatgaaaatgatcgtagaaggcgttatgggtggaaatcttccgtggacattggtatttatcggtgtatttattgcaattatggtcgaactgctgtcaataccggttcttcctttcgcaatcggtttatatctgccgattgaactttctgcctgcattatggtaggtggtatccttcgtctgatcttagaaaaagtatatgaaggaaaagcaaataaagacaaagtgatcaataatggtgtgctttgctgttcaggaatgatcgccggtgaaggtcttgtcggtattctgcttgctattcttgcagttgctacagtaaatggtaagacgattgcagagatcgtagatctgtcaggagttgtgaacttaggacagattggtggactgattgtaatggcattgatcattcttctgatcctcaaatttacaatctggagtaaagaagcaaaggaaacaaaatag

SEQ ID NO: 2981 - DNA, 2316 bp, Clostridium sp.
atggatgaaaagaaagaattcacggagggaagatatatggatattatattaggtattatcttatatgcagaaatgtttcttttgggattttgtacatggagagcaagaacagcgtcgaaaaaagcaggacgtatcgtatattattattgtggactttcttttatttgcagcatcttttttgcaatctatacttatgtaccgcagttagcaattaaggatttttccaagggtatcacatttatctgttttgactggcttctgattctgctgatgctttatacggaatactataccggtttgtttaaagggattcgtgctattaagtatataacatatgtttatgcaatgattgactctgtatcgttatttgctaatacatggactcatcacatttttgaatatcaatatgtcgataatgcagaaagagcgatgcgcattgtacataattattatttgtttgatttgcattttatagtcaattatctttttatgataatggttattttgtcttacttaattatgatcttgcgttcctctaaattttatcgttttcgttatgaagttgtatttatagtgatttttgtgggattcattttggatctgagctcaatgtattctcattttctttataatatatctatgcttgcatttggatgtatgtcaatcctgatatattattttacattggaatatgtaccaaatatgttgattgaaaataccatgtctttggtgattaaagacatgaacaatggaattgtttgctttgataatagtggaaagtgtatttatacaaatgaattgattcagaaattatatgatacagacggcaatgtagaaattttagaacaaaaatatcataaatggctgcatacgacggatcaggtaaaggatgccatgcaattccgtttttctgtcaaaaaggaagaagcagaaaaaacatatgaagttacatataaaagaatttatgacgataagcaaaactggatttgtgattgttttatatttaatgacaggacggaagaaattgcgtctttagagtatgagagatatcgcgcttctcatgacagcatgacgggattgttaaacaaagaacaattttatcaggatgtttatgagctgattcatcagaatccggataaaaaatattgtctggtttgcagtaatattaaagattttaagtttgtcaatgaattgtttggaatggaaaaaggagatactgttctgcttcgtcaggcagaactcatgcgtgagtatactccaaaaggaaccttattagcgagaatgcaaaatgaccgttttgcaatgtgtcttccacgaaaggatctcagagaagatgtagttcataaagcgatttttaaattacaggaggaaacacaaaacagtgcgttccgtatgcatatctttgtgggggtatatgatatcacaaatattgaagaaccaatcagcattatgtgtgataaagcaaatcttgcaagcacaacgattgagaacgattatcatagtgatattgctttttatagcaagaatctctttgaccgatcaatcgaagaaagaagaatcatcggtgagtttgaaggtgcattaaatcgcaaagaatttgtgatgtttttacaacctcaggtcaatgcgaaaggtgaactgtatggtgcggaagctttagtacgctggcagcatgcacaaagaggactgctttcaccggcgatgtttattgatgttttggaaaaagcaggactgatctataaactggatcgatatatatgggaaagcgctgcacaaaagttaaaagaatggaaggacaagggagcagagcaatatcatatatcggttaatatttctacgaaggatttttattttgtagatatttatgagacatttaccggactcatagaaaagtatgatatctgtccggatcgcctgaatcttgagattacggagacggcattaatgtctgactttgataaaaatatggagattctaaaacagcttcgggaatatggatttaagattgagatagacgattttggaagtggatactcttcgttgaatatgttaaaagatatcagtgcagatgtattaaagattgatatgggatttttacgtgcatccgaaaatgaagcaaaaggaatggatatcttagaaagtatcattatacttgccggcaagcttggaatggatgtgataacagaaggcgttgagatgaaaaaacagtttacgatgctaagtaacatgggctgtggtatttttcagggatattatttttcaaaaccaattccaacgaatgagtttgaagacaagtatcatatttttaacgtataa

SEQ ID NO: 2982 - DNA, 2292 bp, Clostridium sp.
atggatgtgtatgataggacgcatcgcaatgtggaagagagggagagtatgtacgagaacgaaattgcacagattacagcaagaaattcgaatgaggagatttattccggtctgttagaactggcaggaaagatcacacagcagaaagggcgtattgaaggaaagaagaagttatattatatttctgccgaattcctgatcggtaagttattatcgaataatctgatcaatcttggaatttacgatcaggtggcagaaagtttgaaagcacatggaaaatccatggctgagattgaagagatcgagaacgaaccatcacttggaaatggcggactgggacgtttggcagcctgctttttggattcgatcgcaacgctgggacttccgggagatggtattggtctgaactatcatcttggactttttaagcaggaatttgagaaaaatcttcaaaaagaagttccgaatccatggatgacacaaaaaagctggcttcgcagaacagatgtaagctatccggtgattttaggagataagaaagtacagtctgttatgtatgagatagacgtaacaggttatgataacaaatgcaatacattaaagctttttgatctggatactgttgatgaatcaattgtacaggatggtggtattcagtttgataaagaaaacatttctaagaatttaacgttgttcttgtatcctgatgacagtgactatcagggacaattacttcggatctaccagcagtattttatggtcagcaatgcggctcagcttattattgatgaagcacaggcaaaaggaagcaacttgtatgaccttcccgattacgccgtgatccagatcaatgatacacatccaaccatggttattcctgagatgatccgtcagcttgtgttacataatatcgagatggatgatgcaatcgagattgtttcaaagatgtgtgcatatacaaaccatacgatcttagcagaagccttagagacatggcctttgtggttcttggatcgtgttgtaccgcagcttgtgccgatcattaagatgttagatgtcaaggtaaaagaaaaatatcaggatgaacgcgttgcgatcattgataaagatcaaagagtacatatggcacatattgacatccattatggttttagtgtcaatggtgttgcagcattgcatacgaagatcctggaagaaagcgaattaaagccatttaaagatatttatccaaataagtttaataataaaacaaatggtatcacattccgccgctggctgttacattgtgaccacgaactggcagcgtttattaccgaaaagatcggtgacggttataaaaaagatgccgcggaattagaaaaattgctgacggctgcggacaatgcagcagatcttgaaaaaatccttgcgatcaagaagacaaagaagcagcaattaaagagttatttagagcaaaaagagggtgttacgatcgatgaagattccattctggatgttcaggtcaaacgtttgcatgaatataagagacagcagatgaatgcattgtatattatttataaatatatgcagatcaaagcaggtcataagccaaagagaccgatcacaatgatctttggtgcaaaggcagctccggcatatacgatcgcaaaagatatcattcatctgatcttatgcctgtctgaagtgatccgtaaagatcaggaagtcagtccatatctgaaagttgttatgttagagaattataatgtaacatatgcggaaaaagtaatcccggcagcagatgtttccgagcagatctcattagcatcgaaagaagccagcggtaccggtaacatgaagtttatgttaaatggtgcgatcacactcggtacggaagacggagccaatgtagagatccacgaatttgtcggtgatgataatatttatatcttcggagaatccagcaacgaggtcattgaacattataaaaatgcggattatgtagcagaaaagatttatgaccgggatccggaaattgcaaaattagttgactttatcatcagcaaagagttatttgcggtaggtaataaaaagagcctgatccgtttgtatatggaaatcgttacaaaagactggtttatgacacttttggatatcaaagattatatccgtgtcaaagaacagctctttgaagattacgaagaccgcaatgcatgggcaaagaagatgttagtcaatatcagcaaggccggcttcttctcatcagacagaacgatcgagcagtacaatgaagatatctggaaattaaaatag

SEQ ID NO: 2983 - DNA, 1143 bp, Clostridium sp.
atgttatttataaaatcggatgaattgaaaatagggatgcgcctggcaaagcccatttataataaaaatggtgttatgctgtatgaacgtaattcgaaactgaccagacagggtattgtcagcattcagaactttggattgatcggtgtttatattcttgagcctgcagagccggttccgccaatgagtgaagatgatattgagtttgagcgttttcaggcaatggcgatctttacaatacgtgatatccttgatgatgtggcagcacagaaagaaccaaaggggatgtatccttttgcaaatcaggtgatcaagaaatacggttctttataccacaagattaattttgtacaaaacttacgcagtacagaagattatgtttataaacatgcattgaacacagctattttatgtgcattgatctcgaaaaagatggaacttgattttaaagcacagcttgatgtggtcgttggcggtattcttcatgatatcggtgaacttatgatgccgcttgcactgcgcaagatcaagaaagaagagaggtcagaggaggatgaaaagaagatcaatacctattattatgcaggatatcagttgatcaacaaagattatgagctggatgcaggggtaaagagaacaacaacacttgcgatgcgtgatctgtatcagattggagatgcagatgttattcaaaataccaaaaagatcaatgaggtagaaatcttaaaagtagcttccgtatttgatacgatgacagcgatgaagtttgaagaagaaccgatgtcagagattacggcacttcgttaccttttagacggagcaaacggatacgatcagctcgttgtgcaggcgttggtcgacagcattaatgtgttgcagccgggtgtctgtgttgatctgagcaatggagacaaaggtctggtaattgcagaaaatccgaccgatatcttacatccgtttgtattatcattccgtgataaccagatcttaaatcttgcagacagttcggttgccagtggagtacatattgtagatatcatgaaaacaatggataaccgtcatattgtcgatcatgaagctttagcaaagtataaaggtgaaaccgtacatttaggtgaagtccgtactaataaacattattag

SEQ ID NO: 2984 - DNA, 1923 bp, Clostridium sp.
gtgcgaaaagataaaaaagtaattggaatttgtgtcgcatccatgcaaagtgacagttgggaaaagcatgtgcgtgcgatttgcaaagaagcaggaaaaagagattataccgttatgatctttaatacattccagcgcttatatgaggtgactaagtttggtgaaggggaagtcagagtatttgatatgattccttttcagaagcttggggttttgatcgttttttctgagtcgattgcaaataatgagatatcagaacagctggtacaaaaagcaaaagatgccggtgtgcctgttattacgatagacagaaggatgaaaggctgccataacgtattatttgcatatgaagaatcctttgaaaaagtagttcgtcatgtgatcgaagatcatggctgtaaaaagattaatttcatggcaggttttgaacataatgagttttcggatgcgagaatcggcatttttaaaaaagtcttagaacagaatgatctggtctttgagccggaacgactggcttatggacagttttgggagatgccggcaagacacgcctgtgaagaatgggttgcaaaatggcagcgcggagaacaaagtatgccggaagcagtaatctgcgcaaatgatattatggcattgacagtaatgaatgttttaacgaatcacggtatttgtattccaaaagatgttattgtgaccggctttgacggattagagttagagcaatattgtactccgagattgacgacagcaacagatgatgtccgccagatcggaaagagtatgttagacattattgatcgttgtattgaaaatccgacagaagaacccaaagatttgtatattccgtttcatacccggtttacggaatcctgtggttgcgaaccgatcaagagttgcaatccgaatgaacggatcatgcagctttacggatatgcggctgagatgcgtcagcagtcaaccgatacgttctttatgatgacaacgctgacagatggatattctgctgtagaaatgggaaataaattaaaagactatcgtaaagcaattgatgcaaaatatatgatgctttttttggatccttcttattataaggagacagatatcccgacaaaccattttgaaaaagactcgtatgttttgtttacacaattaaaagataatgtatacgatgttccgttagaagaagtaaagaaagatgaatttatagataagatctgctggatggcagaaaaaaaggagcctttattatttattccaatccattgtcaggaggaaaactatggatttatggtaacaacatatgattatgagggaaaagataccagggcattttatgaatttgtattggggttagatcaggtgttaggaacaatccgcagacaatcccagcttcatcgtagttatgtcacggatgccttgaccggtctgtataacagaaggggcttctatcttcgttttgaaaagaagatgaagcagcttgccgatcaggataaatatctttttatggcatctgtggatatggatggattaaagtttatcaatgatacatatggtcatgctgaaggagattttgcaatcaaacgtttggcagaaattttgcaggaaatggtaacggatgggcacggaatctgtgctcgtttcggcggtgatgaatatatggttgtgcagcttatggaagcagaaaaaatagatcatgatttttgtgaccattttgagcagcggcttcaggataaaatcaggcaggacaaccaaaagaaaaaagcggtctatgaattaagtgccagttgtggggtgattggcagaaagattcagaatgcagaggaaattgatactatgatgaaagaaacagatgagaagatgtatcaatgcaaatgcaggcatcataacagcagagaagccagaagcagacagaaaagtatgtaa

SEQ ID NO: 2985 - DNA, 1500 bp, Clostridium sp.
atggaggaaatcatggaagtaatgtatcagagtacacgcagtacaggaaagaaagtaacagcttcacaggcaatcttaaaaggacttgctgatgatggcggactttttgtgccggatgcaattccgcagttagatgtctctttggatgaaattgcaaagatgaactatcaggaaaccgcatatcaggttatgaagcagttttttacggactttacacaagaagaattagaaaaatgtatcgaacgtgcttatgatgcaaaatttgatacgaaagagatcgcacctttggtagaaaaagacggagtctattatctggaacttttccatggtgcaacgatcgcatttaaagatatggcactttccattcttccacatcttcttacgacttctgctaagaagaaccatattacaaaccagatcgtgatcctgacggctacatcaggagataccggaaaagctgctttagccggatttgccgatgtagaaggtacaagcattatcgtgttctatccaaagaatggtgttagtgcgatccaggaaagacagatggtaacacaaaaaggcgctaatacaaaagtcgttggtatcaccggaaactttgatgatgcacaaagcggtgtaaaagcaatgtttaataataaggaactggcaaaagccatgaatgcaaagggataccagttctcatctgcaaattcgatcaacatcggacgtctggtgccacaggttgtttactatgtatattcttatacaagacttcttgcacagggagcggtaaaagaaggtgaacaggttaattttgtagtaccgacaggaaactttggtaatattttagcggcattttatgcaaagaacatgggtgtgccggttggcaagctgatctgtgcgtcgaatgataacaaggtattatatgatttctttgagaccggagtttacgataaaaaccgtgagtttattttaacaacatcaccatctatggatattctgatctcaagtaacttagaacgtctgatctataagattgccggcgaagatgcaaaagcaactgctgatatgatggcagcacttgctaaagatggtaaatatagtatcacagatgcaatgaaagagcagatgaaagactttatcggtggatgggcaagtgaagaaaagacagcttctgagatcaagagagtttatgaaaagacaggctatgtcatggatacccatacagcagttgcatcggctgtatatcatgattacaaagaaaagacaggtgaccagacaaaaacggtgatcgcttctacagcaagcccatacaagtttgcaacaagtgttatgacagcgattgacaataaatatgaaggaatggatgattttgcgttgatcgatgagttaagcaagacatcaggcacaacaattccaaaagcagtagaagagatccgtacagcacctgtattgcatgataccgtatgtgaaacagcggatatgcaaaagacagtagaggaaattctcggactgtaa

SEQ ID NO: 2986 - DNA, 2235 bp, Clostridium sp.
atgaagataggtgttgattattacccggagcaatgggatcgttccctgtgggaacaggatgtatgccggatgaaagaagccggtgtagagatcgtccgcatggcagaatttgcatggagctgcttagaacccagggaaggcgtgtatgatttttcctggctcgatgcaatcatagatttatttgaagcaaacggaattgaagtgttcttatgcacaccgacttgtacaccgccacagtggcttttcgaaaaatatcccgaagtgatccaggtagataagagcgggcagcgtattcctatcggtatccgtggtcatcgatgtctgaacaatgctttgtatcgtgaaaaatgtacacagatcattacaaagatggtggaacattaccgggagaagtcttgtgtgacagggtaccagattgataacgaattagaagcaaatcattgctgttgtccgacctgtatacagaaatttcaggaatttgtcaaaaagaaatataaaataatagagagtgttaatcaggcctatggcaacagagtatggagtggggaatatacggatttttcgcagatcaaaccaccattcggaccgtttcagacatggctgaatccatcgtatatgctggattttaatcgttatgcttcgcagagtacggtagaatatgtcgagtttcaaagagaactgatccattctttggatccgaaagcggtgatcacgacaaataactggctctgtgaaaatatgccggatttttatgatatgtttgaaaagttagactttgtttcatatgacaattatccaacaacgaatcttccaaaggacatagaaacgctttattcgcatgcgtttcatctggatctgatgcgtggtatcaagaagaaaaacttctggatcatggaacagctcagcggagggttaggaagttggacaccgatgagtgaaacggtttatccgggaatgttaaaaggctattccttacaggcaatggcacatggagcagatacgattcttcattttcgctggaggacagccgttgccggagcagaaatgttttggcatgggattatagaccacaataatgtattaggtcgcagatacgaagaatttaaagaactttgtcagacgatgaagaaactttcttacttagatggttctatcataaagaataaagtagccattctttattcttcagagcaggaatatggttttaagattcagccacaggtggaaggaatgcattattttacacagctaaaggcttatcatgatgcgtttacctgtcttggtgtcggtgttgatattgtagatgccaaaagtgatctggacgaatatactttagtggtggcaccgaccatgtatatctcggacaaaacgctcgaaggccattttaagaaatatgtaaaacagggcggtcatctggtgttgacgaatcgttccggtgtgaaggatacaaataatcaatgtattatgtcacctttgccgacagtcttttcagagattacgggagcgatcgtaaaagaatataatccgatcggagaaaaggaagagtgcattgaaatccgatcagagcagtggaagaacatctgcgacagacagaacgatcagagcaactcgcatttatcggcattgtctgagccggaaggcaatgaaaaaaattacaaaaacacgcaaagtgatcaggaaagattggatttatcggtattgtttgagtcggaccacaatgaaacggatcataaagacatgcagagtgatcagggcagtttgtatttatcggcattatctgaggcagaatgtaatagaatagatgggggaaaaagagagagcagcacacaaaaacgatatatacagtcgtgccatttatggtgtgatattttagatccaaaacaggcagaaactctggctgtctatggaaccgatttttatgaaggggcggctgcgatcacccaaaattcttattacgaaggaatcggttattatgtaggaacggttccggatagaagaggaatgatctcttttgcaaagcttttgttagaaaatgcatcaattccatatatggagagtcttccgtatggggtagaagtgacagaacgcagaaatgatacaaaaagctgggagctgtattttaataataccatgcacaaacagcattttgatgttatagtacgtcacaaagatcagacagtaaaaaaacatacactggatttgcagccttttgaaatgaaaatcttagaaaagtga

SEQ ID NO: 2987 - DNA, 2295 bp, Clostridium sp.
atggttatgtgttttggtttggaggggaaaatggataaaaaattatatgatctgatggattgggcggaaattgaaacaattgtatattcagagcacgatcatcctgaaaatatattaggaccacataaagtaaaaggcggtgttttgattcaagcgtttttgcccgatgcaaagactgtttttgtcagaagtaagaaaagtggaatgttcatacagatgagccagacggatgaagacggctgctttgccgcgttgatggaaagccgtaagatcgtgtcatatgaatatgtgattgattatggtgatggaaaggagtattggcaaaaagatccgtatctgtatggaaatctgatccccgagcaggcgttagaagattttaatgcaggaaaagcatacgatatttatcgttatttgggggctcatcctgtagccgtaaaaggcattggaaaagatgttttggtagattggaatccaatggctgccagcacaaaaagatctgatatggtacagggaactttctttgcagtctgggctccgaatgcaatgcgtgtcagtgtcgtaggcgattttaatcaatgggatggcagaagacatccgatgtgccggctcggtgatagtggcgtttttggactgttcataccggatattggctgtggcgatatttataaatatgagctgaaatacaatgcccggacgattgctttaaaatcagatccatatggttttcaatatgaagattccatgacgatggcaagtatcattaccgatttgcaaaattttttatgggaagatgccgaatggatgcaaaaaaggcagaaaatacagattacacaagaagcacttaacatatatgaagtcagtctggatggttggctttccaaagaagacaaggatgcaggaaagggttatcgggacgcagcaaaaactttggcgaaatatgtaaaaggaatggggtatacccatattcagctcatgcctctgatggaacgtgtacagaaaaattcttatggatatccaacagttggatattacgcaattcgttcgtgctatggaacaccaaaagattttatgtatttcgttgattatatgcatcaaaacggaatcggtgtgatcatggaatggataccgggatatttttcgacgcaggagcaggggcttgcaatgtttgacggaacctgtttgtatgagcatctgaatcctttacagggtttgcatccgttttacgatgccatgctttttcaatatgaaagaccggaagttgctaacttcttacttgcgaatgcgttatattggaaagaaatgtatcatttagatggtatctgtgtgggtggcatggagacaatgctgtatctggactacggacgaaaagaaggggaatggataccgaaccgttatggcggtaacgaaaatctgggtggaatcgacgttttaaagaaactggcagctctctttcatcaaaaagaggatggggcaattctgatcgcaaaagaagagatggcaagtcttggagttaccgatccattggaagataacggactcggttttgatctgaaatggaatatatgctggacaagcgattttctgaaatatatgaagttagaccctctgtttcgaaaaggaagtcatggtcttattacgatggaaatgctataccattatagtgcaaactttattctgactatttcacatcgggacacatggaaaaagaaaagctctctttttgaaaatatgccgggaacaatatatgataagtttagtaatatacgtgtcggatttggatacatgatcacacatccgggtaagaaaatgctttttatgggagaagagtttggagtagaagacagaaaaaatactgacggatcgcttgactgggaacaggctcaaagtaaagaacatgcacaattacagcgttatgtcaaagatctgaatatgctatatcgaaatcataccgcactctatgtgatggattacagacaggatggctttgaatggatcagctgtatggatgctgatcatagtattattgctttcctgcgcaaagatcaggatgatattttgcttgtaatctgtaattttacacctgtattgtatgagaattttaaagtgggtgttccgtttatgggaagatataaagagatctttaacagtgatagaacaatttatggcggagcaggttatgcaaattcaaacgaattaacagcaaaagaagtatcatgggacggaagaagtcattcgatcgcaataaaacttcctccatatggtttttgtgtctttcgggcggttcctgaaaaataa

SEQ ID NO: 2988 - DNA, 1356 bp, Clostridium sp.
atgaccaatggaaaaacaatggacatgacacatggttctttatggaataaaattctgatctttgctttgccattagctgcaagcagtattttgcagcagttatttaattcggttgatacggcagttgttgggcggtttgccagcagtcgggcattggcagcggtaggaagcaacagctctctgatctctttgatgatcaatctgtttatcggtatttcgctcggttccaatgttgtgatcgcacattatatagggcaaaaagcgaaagacagcattcagtctgcggtacatacagcaatcgtggttgctgttcttagcggtctttttgtaatgatcgcaggacagtttattgccagaccggtacttcttttgatgggaacgccaaaagatgtcatacagatggcagtattatatttgaggatctatctgcttggaatgccttttattatgttatatgattttggctcttccattttacgaagtattggagacagcagaagaccattatacagtctgatcgcagccggtattgtaaatactgtattaaacctggttcttgtcattgtgtttcatcttagtgtagcaggggtagcaatcgctaccgtcatatccaatatggtcagttccggtattattatatatattcttttgcatgaagcggaaccgatccgcctggatataaagaagttaaagattgcatccaaacagttaaaaaagatattgatgatcggcatcccggcaggattacagggaatgatgttttcgatcgctaatgtgtgtatccagagtgcaatcaacagctttggttcgaatgcgatcgcaggatcggcagcagcattaaactatgagttcttttcgtattttatggtcaatgcctttgcacaggcagcagttacgtttacaagtcagaactatggtgccggtcaaaaagacagatgcaaaaagatctttcggttatccatgctcttttccattcttttttgtggaacattatcttgcatttttgtgctgggaagagacttctttttacatttgtatacaaccgatgaggcagtataccggtttgcggtacagcgaattttgatcgtaacgacactggaatttctgacctctgtttatgagatcagtgcaggtgccatgcggggactcggacattcccttctccctgctgtgatcacttgtgtcggctcttgtgtgttacgtctgatatggatcgcaacagtatgccggatttatcatacattctgggtgttattgatcatttatccgatttcatgggtgatcaccggagtttcgatgatgacagcgtatcattttatcaaaaaaagagtatttcgcaaaacggtagcagtataa

SEQ ID NO: 2989 - DNA, 1482 bp, Clostridium sp.
atggaggcacttatgtggacagacagcagaaagacaaaaagacaaaagacagtgatccgaaaaaggacaagtcggggatttttgttctttctgcttttttgtaccatccttttgaacgggctgtccggtaagaatgcacaggcagcaagtgcttcgattacgatcgataccagcaaaaagcaggttgtcaaaggagatacggtgtatgttgtgatcacagtcagttcatctgagagtatcaagagctttaacggttatttttcatatgataaccgctatcttcaatttgtaaacggtggcagtgtggtacatggaaatgatgataagtttttagtagatgatattaatcgtaccggcagtgcgacaaagttaaagtattccatcaaattcaaagcacgtaagaaaggaagtaccacgatcgcattacaaaagccatataaagtgtgtgcagatgacagttcttccggtgagatgtcggtttcttacaatgcgctaaatattgctgttttgtcaaagaaagaggctattgcaagcagtcagccacagcagagtaatacagaagcacttccaaatgctacagatcatccacagacagaagtatccggcaaacctgagacatcaccggatagagccaatgcaaaaaatcaaccgggtccgtcaaaagatcccaaggcttcggcaacaccggaagtcacaagagggccggatgatattgcgggttcttccagacttcgtaaactttcgattacagatgcccagatcgcaccggaatttcagccatcgattcgaaagtacagcggatttgtaacaaccaatcaggacacgcttgacatttcctatgaagcagaagacagcaaggcatctgttacggtaaaaggaaataaaaatctaaaagaaggaaaacatacgattaaaattgttgtaacttctgtcaaccataaaaagaccgtatatcgttttcaattaaatgttgcgaagcaggatcagacaaaagatggagcaaattcgatacaggtgacgcagaccaatggaaagacctatctgagtggcggattgcaaatagaattgttagagttggaagatgaaagcctgcttcctgatggtttttcaaagacaacgatagagatagccggaaatgagcttacagcatttacattagatagtagcacggattacaattatgtgttactctatggaaagggtgatgcagagggatttttcctatatgataagcaggaaggagcactttatccgtatgaaaaagtaaagcaatggtatcgcagtcaggcaaaagacagtcaggacagtacacagacgcagacaatcagaagttatcaatatatcattgcgatcatggctgttttgtgtgtattgatgttagtgatcacggttgcgtttggaatgcatcgcaattatcaaaaagaaatatgggaacaggaaatagaagaaatagataatgatgagatgaaggaggatagatag

SEQ ID NO: 2990 - DNA, 2241 bp, Clostridium sp.
atgatatttgcagacatcatagttgatgtgtccgtaaaaagccttgaccgtccgtttcaatatctggttcccgaagaaatggtagcagatgctgtgatcggtgcgagtgttatcattccttttggaaaaggaaaccgtgaaatgaaaggctatatcataggtttgtcggggacagccaaatatgatattcataaaacaaaaagtatcctacgagtagaaaagcagggagtggttgcagaatcacacctgctttcacttgcttactggatcaaggaaaattttggcggaacgatgaatgatgcgatcaaggctgttatgccggttcgaaaagaagtaaaggaaaaggtcgcacgccacattattcccgctctttcaaggaaagaaatggaacaaaaaaaggtttatttcgaacaaaaacacaatacagcacgtgcccgtatcttacagggacttttagagcagaaggactatgaaaagggtgcatcctatgaaacgtttcttcaccggtttaaagcgacagctgccctgttaaaaggactcgaagaaaaaggaattcttaaaattgtatcaaaacagatctaccgggatccgctttctgataacagagtcgtcacaaaagcaaaagtcttaaacgaagagcaaagaacgatcgtagagcagtttataacggactttgacgcaggaatccgaaaggattatctgatccatggtgtgacaggaagcggcaagacagaagtctatatgaatctgatcgatcatgtactccaaaaaggaaagcaggcgatcgtgttgatccctgagattgcattgacctttcagaccgtacagcgtttctatggcagatttggttcaaaagtttcgatcatgcattcccgtctgtctgccggagaacgttatgatcagtttgttcgggcaaaaagaggcgagatacagattatgatcgggccacggtcagcgttgtttacgccattttccaatcttggattgatcgtgatcgatgaagagcatgaaagcagttatcaaagcgacagtccaccaaagtatcatgccagagaagtagcagtacaacgggcaaaaatgctgcatgccagtgttgtaatgggatcagcaactccttcgcttgaagcatattaccgttgccagacgggggaatattcccttatgactttgacaaaacgtgccggaaatgcacagatggcagaagtagaaattgccgatctgcgtgcggaattaaaagcaagaaatttttcgatctttagccgtagactacaggaagagattaaagtgcggctacaaaaaagagagcagatcattctgtttattaaccggagaggttatgcaggatttgtatcctgccgggaatgtggagaagtgatacaatgcgacagctgctcggtagcaatgaaaccacatgaatataaagggaaagtcagtatattaaaatgccattattgcggtgcacaaaaacaaatgccaaaagtctgtccggcatgcggttctaaatatatcggaaccttcggtctgggaacgcaacaggtggaagaaatgatccataaacatttcccggaggcccgtgtgcttcgtatggatgcagataccacaagcggaaaagaaggacatagcaggatcttacagcagtttgcacagcaaaaagcagatattttggttggtacacagatgatcgtaaaaggacatgattttgaaaatgttactttagtaggcattctggcagctgatctgtcattaaataccggaagttaccgtgcagccgaacgtacttttgcattgcttgcacaggcttgtgggcgtgccggaagagggaaaaaagcaggtaaagtgatcttacaaacttatcagccggatcattacagtattcaatgtgcggctgcacaggattataaagcattttacaggcaggagatcgccaaaagacaaatgttgcaatatccgccgatttccaatatactagaagtgttggtgttttctgagaaagaagaaaaagcggccatgttagcagaagtattgaagagtaaaaccatatcgtatcatgatatgatcgtactggggccgaatgatgcaccgattgcaaagcttcgggatgtttatcgcaagattttatatattcgttccaaagattatcaaatgctttgcaatgtgaaagatcattttgagaaatttatgcagacaagccatatgtataatgactgcaggatcacattcacgtttaacaatgaatcttaa

SEQ ID NO: 2991 - DNA, 984 bp, Clostridium sp.
gtgtttggttttggtcaattgattaacattttaaagaagaatcccaaaaagatcgtgttcacagaaggtgaagatgcacgaattttggaggcttcatcaagacttttagcaagcaactttttacatccaatattaattggaaatgcagaaaaaattgcaatagcagcagaagaatgcggttttaatatccgtggtgctgagattatagatcctgaacactttgacagaatggatgaaatggtggatcttttatgtgagcttcgtaagaaaaaaggaatctcgccggaaagagcaagagagattttattacaggcaaattattttggaaccatgcttgtaaagatgggcattgcagatgcccttctcggaggtgctacatattcaacagccgataccgtaagaccggcattacagttgattaaaacaaaaccggagaacaatattgtgtcttcatgctttatcctggttcgaccaagtgcaaccggtgaaaatgaggttcttgcgatggcagactgtgcgatcaatattgaaccaaacgaagatgagcttgtagagattgccggggaagccgcagaatgtgcaaaaatcttcggtgttgatccacagattgcattcttaagttattctacacatggttcaggaaagggcgatgctgttgacaagatgcgtaatgcagcagagaaaacaagagcaaaataccctgaacttccaattgacggggagttacaatttgatgcagccgtttcacctcgtgttgcaagaacaaagtgtccggagtcaaaagtagcaggtcatgcaaatacgtttatcttcccggatatcaatgcaggaaatattggttataagattgcacagcgcatgggtaactttgatgcgtatggaccgatccttttaggattgaatgcaccggttaatgatctgtccagaggatgcaacgcttctgaagtatattctatggcgatcattacagcagctttagcataa

SEQ ID NO: 2992 - DNA, 2586 bp, Clostridium sp.
atggagcattatagtgtaaccggtatgagctgtgctgcctgcagttcacgcgtggaaaaagccgtttcaaaagtcgatggtgttacagagtgtacagtcagccttttgaccaattcaatgacagtagaaggaactgcggcaccggaaacaatcattcaggcagtaaaagatgcaggatatggagccacgcaaaaagataaagcagcaggaaaacagagcagatcccaggaagatgagatgtcagaaatagaagataaagagatcaaaacattgagaaaccgcctgtgttcatccgttgtttttttgcttttgttgatgtatctgtcgatgggacatatgatgtggggctggccattgccgggatttttaaaagataatcatgtggcaatgggactgatccagatgcttttgacgatcgtgatcatggtgatcaatcagaagttctttgtcagcggttttaagagtcttttgcaccgctctcctaatatggatacacttgtagcattaggatccggtgcggctttcggatacagcacatatgccctttttgccatgaccgatgcccagatgaaaaatgatatgcatacggttatggggtatatgcatgagttctattttgaatcagcggcaatgatcctgacgttgatcacagtcggcaagatgttagaagcatattcaaaaggaaagacaaccaatgcgatcaagagtctgctacagcttgcaccaaagaaagcttccgtactccgcaatggtgaatatgtagaagtttctactgaggaagtaagagtagatgatcttttcttagtccatcccggagagagtatcccggtagatggtattgtagtcgaaggcaacagcgccgtcaacgaagcatctctgaccggagaaagtattccggttgataagacaaaaggagatacggtatctgcggcaacagtaaatcagtccggtgttctgacatgcaaggcagtcagaatcggagaagatactacattatcgcagatcatccacatggtcagcgatgcggcggcaaccaaagcaccgatcgcaaaagtagcagataaagtatcaggtgtatttgttccgactgtattattgattgcagcagtcactacgattatctggcttttggcaggacaggatgttggttttgcattggcaagaggaatttccgtattagtgatcagctgcccgtgtgcacttggacttgcgacacctgttgcgatcatggtcggaaatggtgttggtgcaaagaatggtattatgtttaaaaatgcatctgccttggaagaggcaggaagaatacgccggatcgcactcgataagacaggtacgatcacaaaaggagagccggaagttacggatattgtggcagcagagggtgtcacaaaagatgaacttttattgtatgcctatgcgttagaaaagaatagtgaacatcctttagcaaaagcgatccatatgtatgcacagaaaaaaaagatcgaggcaaaagaagtggacgaactggaagcattagccggtcatggattacaggcaaaaataaatggcaaaggcttatacggtggcaatcgtggttttgttgaagagaaagtggcggttgcaaatgagatattacaaaagggtgagcagtttgccaaagaaggcaagacaccattatattttgcaatggatcagaaaatgcttggtctgatcgcagtagccgatgtgttaaaagaagaagcggcacaggcggtacaggaattacaggatcttggtattcatgttacaatgcttaccggagatcatgaagaaacagcaaaagcgatcggccgtcttgccggtgttgatgaagtgatcgcaggtgtacttcctgatggaaaggaaagcacgatccgtactttacagcaaagaggaaaagttgcaatggtcggagacggtatcaatgatgcaccggcattaacaagagcagatgttggtgtagcaatcggagccggaaccgatattgcgattgatgccgcagatgttgtcttaatgaagagcaatgtcagagacattccggcaatgatccggttaagtcgtgccacgttacgaaatattcatgaaaacttattctgggcatttatctataatgtgatcgggattccgctggcagcaggtgcatggatctccttattccattgggagttaaatccgatgtttggtgctgcggcaatgagtttatcaagtttttgtgtagtatcgaatgcattgcgtttgaatttatgtaagatctatgatgcaaaaaagaagcataaccataaaatggaagaacccgtcatagaaaataaagcaagttcacaggaaccgctcgcagagcagtcactgaataaaattaagaaagaagaggacaaaaagatggaaaaagaaatgaaaattgaaggaatgatgtgtggtcattgtgaggcaagagtgaagaaagcattagaagcggttgatggtgtgaaagaagcaatcgtcagccatgagaaaaagaatgcgatcgtaacattagaaaaagaggtcgcaaacgatgttttaaaagaagctgttgaagcacaggactatgaagtaacatcgatccaataa

SEQ ID NO: 2993 - DNA, 1194 bp, Clostridium sp.
atgttaaaaggaaagacagttgtattaggtgtaaccggaagtattgctgcctataagatagcaaatcttgcgagtatgctttctaagcttcatgcagatatacatgttttgatgacagaaaatgcaacaaattttattaacccgatcacatttgaaacactgaccggacacaaatgtctgatcgatacttttgatcgtaattttcaatatagtgtagagcatgtgtctcttgcaaagaaggcggatgttgtattagttgcaccggcatctgcaaatgtgattggaaaaattgcaaacggaattgccgacgatatgctgacaacaaccgttatggcgtgcccatgcaaaaagatcatttctccggcaatgaatacgaatatgtatgaaaattctatcgtacaggagaacttagacaaactaaagagacatggttacgagatcattgaaccggcagtcggactgttagcctgtaaagatgtgggagcaggaaagctgccatccgaagaagttttactcgaatatatcttaaaagagatccgctttgaaaaagatatggcaggcaaaaaagtattagtcactgcaggaccgacgatggaagcaatcgatccggtacgctttatttcgaaccattctaccgggaaaatgggttatgcgatcgcacgcattgcgatgcagcgtggagcagaagttactttagtaacaggacctacgcatcttgaagcacctccgtttgttcgtgctatcccggtcacaagcgcgcaagatatgtttgaggcggttgcatccaatgcaaaagagcaggacatcatcatcaaatcggcagcagttgcagattacacaccggtatcggttgccaatgaaaagatcaagaaaatggatggtgacagtcagatttcactaaaacggacaacggatattttgaaatatttaggcgagaatcgtaccaaagagcagttcttatgcggcttttcgatggaaacagaaaatatgctggaaaactccaagaaaaaattagcaaagaaaaatctcgatatggtcgtagccaataatctgaaagtcgaaggtgcaggatttggcgtagatacgaatgttgttacgctgatcacaaaagaggatgtcaaagagcttccgtgtatgaccaaagaagaagtagcaatcgctattttagatacgatcaggaagaaaatgaaataa

SEQ ID NO: 2994 - DNA, 2529 bp, Clostridium sp.
atgaaagcatattcgtatgaagagaaaaaggcaacagcacatatcggaatgatcgggacaaatgtgcttattctctttgcgttttctttacttgtgggaattctgttttgcgaattcgtttgtcataagaatattacgatctatcaggggctcgtgcttgtatgctgttgcgttgtcatatcatttctttggtattttttaaaaaggaaagtacatcatccctttttgataggaagtgccgggatctgcctgctttctttgcctggtggtgtcttttggtggaatggtgcattacagacaataaatggcattttgcaatggtatagcaaacgaacaggaaatcttgcagaagaatatgctgtcagtgaccggtttgtggcagttggaactatcttttttgcaagcagtctgttactgctttccttatggatcatacaatattttctggatcgtcggaacgtaccgggcatggttatcggtatgcttccgttttatctggtcgcatttttctttggaaagcattttgtgataatgtgtgcgatcggattgtggatagtatttttgtattgtctgcatgatgcatttcgttatggttatgttctttctgcccaaaaagagaaatgcacaatcgggcttttgacattgtgtatattgttgacagggattgctaccggagcaggaattgtttatgaggatcagtttgtgcagtggaaaagggcagaaaagaacaagatagaaacaaaagcgtttggtacagccgatctttacgaaggcgattttacaggaaagagaaaagcgaccgattcaaaagagctgcgtcttacagtagagacagacagtgacagcgtattttatctgaaaggttttgtcggcagtaattatcaggatcgacaatggaaagcattggatgattcagtatatgcaaagaagcaccaggaacgtttccgctggcttgcgaaccggaattggagtgtctggacgcaggaatttaaagcattgtcggcaacttcttatagagagcagggtacgaagaaagttcgtgttaagaatgtacaggcaagcagaaaatatcaatatcagccgtattttggcatgacaaatgccggaagtatgcttaaaaaaggtcatgacagtacattgcaaaatgaatggtacgctgtcaaaaaagacacgacataccggatgatcgaaatgaaagatatggattatctgacgattcagactttggcacagttagaagccagacaatcccaaaaagaaatatctgattatctggaaagtgaatggacttacagagaatttgtaaaagaagaatatcttaccattccaaaagaatttcaacgcttttttacacaacagatcaaaaagaatgtacaaacaatgtctgtgcaggaaaaagcaacgatgatccgccagtatttattagatctgacagatggaaatgaagagacagccgatgattttactgatcagaactatgctgatccgatccttgcttttttgcagaaacaaagagccgggggaagtgtttcttatgcgtcagccggaacgcttttgtttcggtatctgggagtcccggcaagatatgtggaaggatatgtgtctttaccggagagtatgaacagtacggctgccgatacacagacagatgatgagacagacggaactttgcacgaaaaaaacagcggaatgtccgcgcagactatccgtaatatctatgcagacgaagctcatgcatgggttgaaatctatcaggatggacttggatggataccggttgaggtctctccgaaatattatggagaaggcgagaaggcacacagaaaacagcgtgtggatcaggttaaaacagaagaattgcaaatgaatgttaagatgccgccgaaaaaactttctgagaaacatacaataccgattcagagatacgttggcattatgcttggcatgattgtgctattaattgtatttttgcttttacatcggagtatctgccgatatcagaggaagaaaggaaggcagcagggaacactgccggatcagatcggctatcttgcaaaagaattgtcctattggttaaaagcagatggaatgcatgaaatgatacaaagaagtgatgcctttatcgatcagatgcaaaagtatgagcgtctatctgatgatcgtactcaaaagagcccgtcaaatgattggtcacagcaaagtgaaaatgattggaaagagcatcaagatgaaaaatctaagaatggttttgctaagacagataaatatattcaacggaattttcagaaaaaagcttcttcaagcgattttgcaaaagcaggaaaaaatatatcgtccgatatttggaaaaaggaatgcaatattgagcaggttcttacaattttagagcgaagagctttctcggaagaagaagcaaaagcagaagaaaaacactctatggaaatctacgtagaacatatcagaaagcagatttttcggaacgcaagtcgtttcaaaaaggcagttcttgtaatctggtatggtatttaa

SEQ ID NO: 2995 - DNA, 1290 bp, Clostridium sp.
atggaaaaacataataatgtcaaagggaaactgatcggtgggattttagcggttgtgcttccgtttctgatcatacagggagtcatttatgagttgcttcagtatggagtgatcaagacggcaattgcatttgtattaaatgcaattgttgcggcaatcgcattttttattatatacaacatttttaaagttttactgcttccgtttcaggctgccatcactggagaaacaatccgaaaaaactcggtggttgctaaaaagatggaaaaattaacttcaagagatgatgagattggcaaagtagcaagagaaattcagtccaatgttgaaacatttgcggaaacgatcagtgcgatccgcatcgcaacttcagaattagaggaagtttctggcgaatttgcacagatgtttgaaaacatgaatgaagtagcggatagtaccaatagtgcagtagaaataatcacagataatacatcgatccaggcagacaaagtaagtgatatcaagaagatgacagagcagatcagtgagggtgtggatcatatcttaaataatgtggaatcattaaagcaaagtgtagatacggtattagattgcaatcatgctgcatccgagatcatgaaagaacttgtagatatcagtgaagaaagcggacatgcaatggaagaagttggcacacagacaacacgtaccaacgagtctgcacaggagatccagaaggtgacgggtattattgccggcatttccaatcagacaaatcttcttgcactgaatgcaagtattgaagcagccagagcaggtgagaatggaaaaggttttgctgttgtagcagaacagattcgtgagctggctgaccagtccagagaatcaacagaacatatcagcgagatcgttaacggtctgattgcaaattcaaatacaagtgtagagattaccaagaaagtatccgaagcttttgaaaagcaggatgagaagattaaagatacagagtctgttttcggtacattaaattccgagatcaagagagtcggttctgcaatcgatgagatagatcgggaggtatctgatcttgatgagcataagaatgtgattgcagaaggtgttgaaaaccttgcacaatttgctcaggaaaatgcagagagcggacgtgttacaaaggaaaatatggacaatcttggacaggttatgcagcagtgtaagatttcgacaaagaagattggttctgtatcagaaaaactagtagaaaagattaaaaacttaaaatcagaaggaatgaaaaaacttcactaa

SEQ ID NO: 2996 - DNA, 1905 bp, Clostridium sp.
atgctgagaaaagaggagcttatgaaaaatattagttttaaggtagtgataccacagattgttttagcaatcgtctgcattgtttcggctgtatggggaatccggtcaacacaatatctgaaagcagaaagtatacaaaaatcagaagaaaatattaatgcgattcattcgcttgatactttgtcgaatgactttcagatcatgcagaaacttcttttgacgcatttccttaccggtaatgaggacgagatcgttgttgtcagaaataagattgatgacacaataagcaatgtagaaaaggaaatgaaaacctatcagaaatatgttactgatccgacagaaaagaaattatattcggagttcttagagaaatacaattctcttcatgacctttatatgaaatctttgaaatatagtgaaaatgaagaaaaatcggatgcgatcgagttagcaaacggtgatatttctgatgttgaatctgagatggaaggtatcgttgataatctgatcagtaatcgtcagaagtcagctcagaggtctgcccaggaacaatcgaagacatttgataattcgatcagtatgaataatgcattgattgttatttcaattgtgatcagtattattgcaatcatttcatgctatatcacgatcgttacaccgacgaagcgttctatcaaacgtttgcgccatattatcaagaaaatagagaacaaccagtgtgatcttggtgaaagaattccggttcgcacaaaagatgaagttggtcagctcgttatgggtatcaactctatgttagaaacattacagagtgttatcggtgatatttcagatgaatctgttaatttagatcaggctattgctaatgtgacagaaagtgttggcaatgcgaatgtaaattcaagcgatgtgtctgaagtaatggaacagcttgcagcttctatggaagaagtggcagcaactatttcgaatgtagaagacaaagtcgaagcagttggaacaaacatttcagcatttgccgagaagagcgattcgatcatgaaatatgctcagacaatgcaggaaagggcagaaggtcttgaaaagtcagcaattgacagtcagagtgtaacaggtcagatgacaagtgaaatgattgaaaagatcaagcatgcaatagaaaacagtagaagtgtagaacagattgaaaatctgacaaaccagattctttcgatttcaagccagacaaaccttcttgcattgaatgcatccattgaggctgccagagcaggagaagccggtaagggctttgctgttgtagcagatgagattcgccaattggcagacagcagccgcgagacagcgaataacatccagaagattaatgcttctgttattgcagcagtaaatgaattaagtgataattcaaatcagatggtagaatatattgataacacaatcttaccggattatgacggcttcgtagattccggaagacagtataatcaggattctatttatgtcaataatgaaatgttgatgtttgtaaaagaaacagacgagatcacacagatcacacaggagcttgtaaaatctattgaacagatcacacaggttgttgaagatagtgcacttagtgtagaagaagccgctaagggagctgtttctctgtcaaatgagattgctaagatccagcaggatatgaatgtcagtggtaatgttgccacgaatatgaagaaacagtgtgagcgcttcatggatacagacagtgcgaatacagtaacagaagacattgcaacaagcgaaatggaaagcatccatgaaacagactctgaagcacaggaagtttctttagaaacagaagaggaagctgaggatgctgctccaacagttgaagactctgcacaggaacagtcagtagaagagtaa

SEQ ID NO: 2997 - DNA, 2004 bp, Clostridium sp.
atgaaagaaattctatttggtgctgcatattatttagaatatatgccatacgaccgtttgaaagaagatttagacatgatgcagcaggcaggaatgaatacaattcgtattgcggaatctacatggagtacattagaaccaacagacggagagtttgatttttcttatattgatcgtgtgttagaggaagcacaaaagagaaagatgaatgtgatcatcggaacaccaacttatgcgattccatcatggctcgaaaagaaatgtcctgaagtgatggtatataacaaagaaggacgagccagatacggacaccgtcagatcatggatatcatgcatcctgtttttcgaaaatatgctgaaagagcaatctgtaaactggcagagcatacggcagcacatccgtcagtgatcggttttcagatagataacgaaacaaagcactatggtacagcttccagagaagtacaggaacttttcaaagaacatttaaaagaaaaatatcatacaacagaagctttgaataaagctttttatctggcatattggagcaactcgatccatgactgggctgatctgccggatatgttaggctgtattaatggtggactggcaaccgagtttgcggcatttcaaagaagccttgccgcacaatatctgcaatggcagtcggatctggtttcaaaatataagaaaaaagagcagtttattacacataattttgactttgagtggaagaagtttggggcagacatcgcacaggacggttattcttatggagtgcagccggatatcaatcactatgaagcatccaaagccgttacgatagcaggaacggatatttatcatccgacacaggatgaactgacaggagcagagattgcttttggcggtgattcgatccgcagtttaaaatatgataattattttgttttagagtgtcaggcacaagcttttaaatattggacaccatatccgggacagctcagattacatggatacagtcatttagcaagcggtgcgcagagtattttatattggaactggcattcaatccataacggatatgaaacttattggaagggtattttaagtcatgatcttgcaacaaatccgacttacgaagaagcaggagtgatgggacgtgaatttgaaagacttggacaagatacgctttgcattaaaaaagaaaataaggttgccctgatcgttgataacagatctcttgacgcattcaagtggttcccgattgataaagatctaagttacaatgacgttgtccgttggatgtatgatagtctgtatgagatgaatatggaatgtgatattttagatatccatgctttgaatgagagaaatattgtaaagtacagtatgcttgtaactccggttttatatagtattgcagaagaaaagattgctctgatccgtgagtttgtcaaagtaggcggtgtattggtaagttcttttaagtcatttgttgccaatgaagaacttagtgtatatccggatgcacagccacatggtatgacagaatgtttcggtatgcattataatcagtttacagaaccgggcaagacaaaatttgccggagaaccattgtcttattttgcagaattacttcaggtaacgacagcgggttcttatgaaaactacgatcataaatattggggcagatatgccggccttaccgaaaatgcatatggcaaaggctgtgcattttatattggttgttttacatctaaagagatattaaaaaagatttaccgcaaagcatatgccaaagcaaaagagactgtccctgcatttgaatggcctgtgatcattcgcagcggtatcaatgcaaagaacgatacgattcattttctattgcattatagtgaagaagaatgtgagattacttctccatatgatcatacagtagatctgctgagtggcaaagagtatcaaaaaggcgatacgattcatctgactgactgggatgtctgcgtcttaaaagagcaataa

SEQ ID NO: 2998 - DNA, 1323 bp, Clostridium sp.
atgatgagcgcaatattaacaacttaccagggagcttttttagggccgattgcccgtgtactcggaaagattcttgaggcaatttattatgtattgtcacttgtaggaattgaaaatacaggtatttgtattgttttatttacatttttggtaaatgcattgatgcttccgcttcagattaagcaacaaaagtttgctaaaatgtcgaatataatgaatcctgaaatcatggcgattcagaacaaatataaaaataaaaaagatcaggcatcccagcagaagatgtcaatggaaacgcaggctgtatatcagaaatacggtgtcagtccggcaagcggatgtcttccattgttgatcacatttcctattttatttgctttgtatcgtgttatttataatattccggcttatgtaaatcaggtatatgatatttatgccggtgttgctggaaatttaaaagatttagatattacggtagcacagttagctgactttatgaaaacaaaaacttatgtagtaacaaatgcggtaaatgatgctgcgaaaactgctgcaaagacggatattaaatgttatatagatgtcatcggtcagtttaaccaggaggcctgggacaagttaaagaatatggatgtgatacagaatgcgaaaggtgcaaaacaagtattaaaggaaattacaagtacatcaacgcgtgcagcatcaattaattctttttttggaatgaacattgcagatgcacctaaagtcccatttgttggtggaaacgctttgacacttggtttcagcattcctgttttttctgttattacacagattataagtacaaagttaagtatggcaggtacaccacagcagaatatgcaggataatcctactgcaaattctatgaagacaatgaatacggtaatgccatttgtaacaggtgttatgtgttttatgttcccaatcggtgttggtttatactgggtagccggtaatgtatttagaatttttcagcagcttttcattaatctgtattttagtaaagtagatatggaagaaatgttagcaaagaatgccgaaaaagccagagagcgtatgatcaagcgaggtattgatccggataaggttcagaattatgctaagacgaagacaagcacaatcaacaagaatacaggatcacagcctaagaagaatactgcaaatgtaaataaagctgttaataaggcaaagaagagcgattataagcgtcctgaaaattcaaaatacaaagaaggcagtattgcggcatatgcaaatatgttaaaccgcgataaatcgcaagatacaaagaaaaattag

SEQ ID NO: 2999 - DNA, 2361 bp, Clostridium sp.
atgagagtgaataaaaagaaaatggcagcagccggaatcagtgtattattagcttcaggattgttagtaggcagtgtggaatatgcttctcatacattcgcattgagtaaagcagccgcagcagggaatacaaagacagtaacagaaagtgtcaatacaaaagcagcaaagaaagcagatgcttcaaaggtatcaaaagaagaaacggtatatgttacaatggatgctaatggaaaaaaagatgaagtgatcgtttcagactggttaaagaatgcaggtattaatggaaaaatctctgatgtttctgatctgaaagacattcagaatacaaaaggaaatgaaaagtttacacaggatgacagcactctgacctgggatgctaagaaaaatgatatttattatcagggtacatcagacaaagagcttcctgtcggaatggagatatcatataaattagatggcaaagaagtatctgcaaaagatcttgccggtaagagtggaaagtttgagatgaatatcaaatatactaactcttcgaaaaagaaagtgacggtagacggaaaagagacagagatctacacacctttcttaatggctacgggaatgatcctttctactgataaattccagaatatcaaagttgataatggcgaagttgtttcagaaggagacaatgatatcattatggcatatggcatgccgggattaaaagacagtttagatcttgcaggacttgattttggcgatgatgttaccatagataccgataagatcaatgacaagattacggatacggttaagatcacagcagatgtaaaagattttgaaatgggtgcttcttatactgtagcaacagcaagtctgttcaaagatattgactttggtgatattgacagtctcgatgatctggatgataagatggatgacttaaaggatgcagcaaataagcttgtagatggtgcagatactttaagtgatggattaaagacattaaacagcaatatcaagaaatacaataaagcgatcaagacattgaataagagtgtcggtacattaaataccggtgctacaaagttaaaaaaaggagtcggtacttatacaaagtcagcggataagttattcaagggtgtgatcaaatactctgatggtacaaagacatttgcacagagcactaagaaatatacagccggtgcaaaagcattagtcgatggtgccggtaagatttcttcttctgcagagcagttccctgcttcttataaacagttcaatgacagcttaacctcatatgtcaatggcgtaaacacacttcttgcagaagaaaatatgacaaagctttcaagcggtgttaattccttaaaagcaggtgtagagtcgttagacagcggtctgacatcagcgatcagcggtgttgatacgatcaatgttgttgcaaagcagttagaaggaacagatgcaaagacaaaagcattaagagacagcattaacactacgaaagatgcgatggaaacagctgccaagaatgcagcaacagagcaggagaaagcaacttatcaggcacaggttcagttatatgagtctatgcttacttatatggatagtgttcagaaagccggtgtaggactggatgcggctacaaacggtaaaccggacagcgaagtcgctgatcagaatggcaagacagacttaaaacttggtcttcagacaatggaagctgcaacaagcaagacctctacagagacaaatctttataacggattaagtgcattacagagcagtgcaaagacaatgtctgatagtgcagcaacgatccgtggttataagacaccgatcctagaggcaagtggaaagatcaatgcaagtgtaggtactttaacagaagcggtaaagacattatataagagtggtacaacattaactgctaacaataagaaattaaatgatgctgcaacgacattaacaaagagctctaaaacagtaaaatccggttctaagcagttaaaagctaacagtggtacggttcgcagcggtatgagcacattagcaggtggtactaagaaactttacaaagcaacgaacacattagttactacaacaaataaagtagcaaaaggtgttaacaagttagacaacggtgcttccaaacttgcttccggaacaaaagaattcaaggaagatggtgttgataagcttacagataccatgaacagcattttagatggtgtaagtgatacaaaagacagagcagaagctgtaaacaacgcagcagcaaattataagagcttctcaggaatctctggtgaaatggacggcagtgtgaagttcattatgacaacaaaagaaattaaagcagacgacaaataa

SEQ ID NO: 3000 - DNA, 1608 bp, Clostridium sp.
atgacaaaaatattgatcaaaaaacaattgatggaagtattctcctggatctatcaggacaaaaagaccggaaagaacagagataaaaaggggctgctattgtatgtttttttctatgtttttctgtttggttttctggcagttattttttataatatggcagcttctttatgtggtccgttggttgaggacggttttggatggctttatattgcattgatgggaattgtcggaatgtcacttggtgtgtttggcagtgtttttaatacatttgcaagtctttatcaggcaaaagataatgatctgctgctttcactgcctcttccgacacgaagtatattgatcgcacgtctttttggagtctatgcaatgggacttatgtatgaacttttggttatggtacctgctatgatcgtttattttatgcatgtgtcacctaatgtttctgtcgttatctgctgcattctgatcatattgctgctttctgttttcattttgacattatcctgtgttttaggatggatcgttgctttcgtcagcagtaaattaaagaaccagaagatcattactgttttgatctcattggctttctttgctgcctactattatgtatgcggtagtgcaggaaacatgatgcagacattacttcttgatccggcagggatggcagataaagtgaaaggaatcgcatatcctttataccagatgggacttgcggcagaagggaaatggaatgcgtttcttttctttgcatttgcagtgcttgtattatttgctgttatttattttatattacaaaaaagctttttggcattatccattgcaaacaaaggaaataaaaaggcagtttatgtggaaaagaaagcacatacagcttctattccacgggcgttgctgcgaaaagaagtttttcgttttacgcaaagtccgatctatatgttgaattgcggattgggaatcgtatttattctttttgcggctgtaatgttgcttgtaaaaaagggaacagtcgattcgcttcttatgatgtttatcggatatgaggaccggatcgctctggtcgcaacagcagcaatctgtatgctcacaacaatgaacgatatggcagctccgtctgtttctctggaaggaaaaaacatctggatcttacaggtgcttccggtatcaggctggcaggtcttaaaggcaaagcttggcttgcaaatcatattcaacctgattccaacgacatttcttattatctgtgtggaatggatcttaaagcctgcagcagtttttgttgttctgctcccattaacagtagttttgtttattattatgatggcagcttttgggttgacttgtaacttaaaagcgccaaatctgaaatggacgaatgagacggtaccggtcaaacagtcaatgagtgttacggcagcattatttggcggatggatcattgttgcagcattttgttttatctattatttactctataaatattttgaagtgaaggcactttcttttttagttggattagatgttgtacttgctgtgctttgcattttgcttttgaaatggctttgtaaaaaaggcagttttattttcgaaacgttgacaaatgcttaa

SEQ ID NO: 3001 - DNA, 828 bp, Unknown
  Description of Unknown: Clostridiales sequence
aaaaagaacggcgactgctgggatattgaaaccaagcttcacgccgtctacacctgcaaatcggtagtatttgcaaccggtacctttctcggcggacagatttttgtcggagatgtggattatgaaagcggcccggacgggatgttccccgccacacagctttcggtctgccttaaagaaatgggtattcccctgcgccgttttaagaccggcacacctgcccgtgttcaccgcagaagtatagatttctcaaaacttgaacggcaagacggagactcggacattgttcccttttcctttgacactccaaaggaatccttgacaaacagggcggcttgttatattgcttataccaacgaccgcacaaaagaggtcattcttaaaaatcttcaccgttcggccatgtacggccataaaatcaccggtgtcggtccaagatactgtccgagcattgaggacaagatagtccgttttcccgacaagcttcgacatcagaccttcattgagccctgcggacttaacaccgaggaaatgtatcttcagggtctttccacctcccttccggaggacgttcagacagaaatgtaccgaacaatagaaggacttgaaaatgttcagataattcggcctgcatatgccattgaatacgactgtatagatcctctctttttaaaacccacccttgaaattaagggctttgacggactgtacggagcgggacagtttaacggctcctcgggctatgaggaggcggcggctcagggacttattgccggtataaacgccgcaaaaaaggttcagggaaaggaaccttttattgccaaacgc

SEQ ID NO: 3002 - DNA, 858 bp, Unknown
  Description of Unknown: Clostridiales sequence
agttcgctcttctcgatactcatgcagaacaccattcccgaatcttacataagatttcccctcgccctgcttataggaggcgttttcgccgccatattcggcgtgctcatcggaatcccggtgctccgtcttaagggcgattatctcgccatcgtcactctggcctttggcgaaataattcagaactttgcaaaatcaatatatttgggctatgaccagaacggggttcacgcctccctcacctcggcctcggacatgaacatggatatggtcaacggcaccgtgctcataaacgggccccagggaattgagggaactccccacgattcaaactttatcatcggatttattcttgtttttatcacggttgtcatctgtctgaacttcattcactcccgctcgggaagggcggtcatgtccattcgtgacaaccgcattgccgctgagacggtcggcataaacatcaccaaatacaagctgattgccttcggaatttcggcatttttggcaggtgttgccggagttctctattcccataacctcagcattctggccgcatcctccaagaatttcggatacaacatgtccataatgattctggtatttgtggtcttgggcggaatgggcaacatccgcggctcgataatcgccgcaaccgtgctcacccttcttcccgaggtgctcagagaggttgccgactaccgcatgcttatatacgctcttgctctcattatcatgatgatattcacctccaacgacacccttatagcctaccgtcagcggttgattgaatgggttaagaaaatctttgcaaagagcaaaaaagaaaaggaggcggctgataatgtcaattcttaa

SEQ ID NO: 3003 - DNA, 1317 bp, Unknown
  Description of Unknown: Clostridiales sequence
atgaaacggtggtttaaatacataaagccgtatatgctttattttataaccggcccgctgtgtatgattgttgaggttgtgggcgaagtgtttatgcccttctttatggcgcagataataaacaattacagtgccggaaacctgacggtgggctccagtctttggtatatggtgggaatgatagtcactgccctttgcatgatgataggcggggtgggaggcgcatatttcggtgccaaagcgtcggtcaactttgcggccgacataagaagcgatgtttatagaaaggtccaggccttttcttttgcaaatattgaccgtttctccaccggctcgcttgtcacccgtctgaccaacgatgtaacccagcttcagaattttgtcaacatgttgctgagaatggctctcagagcccccggaatgatgataggcgctctcataatggcgatagctctcgagccgcggctgtccatgatttttgttgtaagtattccggtactgctcgtagccgtatttatcataacaaaaatgggcttcccccgttttacaagaatgcaggccaaaattgaccggcttaattccaccgttcaggaaaacataaccaatgtgcgtgtggtaaaatcctttgttcgggaagattttgaagagcagaaatttgccaaggccaacagcggccttaaaaagaccggaatgggagcaatgaaggtaatgattatgctccagcccattatgagtctttgtatgtacgctaccataatggctgccgtgtggttcggaagcaagctggttatgggcaacggcatggcggtcggaaatctttcggcattcataacctatgttactcagatacttatgtctttgcttatggtcaccatgctgtttatgttttcctcccgtgccatggcgtcggccgagcgtatttccgaggtgctggacgaggagcttgatttaagcgacgagcattcggcccgtaaggagctgaccgtaaaagagggcaggatagagtttagggacgtcaatttcagatattataaatccagtaaggatgccgtgctcgaccaaatcaacctgacaatagaaccggggcagacggttggaatcatcggttctaccggctgcggtaagaccaccctggtttcacttatacccaggctttacgactgtgacagcggtcaggtgctggtggacggggtggatgttaaggactacagcctctaccaccttcgtgagggaatcggtatggtgcttcaaaagaatgtgcttttctcgggctcgatttccgacaatcttcgttggggcgaccttgaagccgatgat

SEQ ID NO: 3004 - DNA, 1272 bp, Unknown
  Description of Unknown: Clostridiales sequence
gtcaccatttatcttgacgacgacgaggctttcgacatttggaccaaggaggtaggggtttcacctgaccgcattgtcagacttggcaaggaagataatttctgggagcacggatcgggtccctgcggaccatgttcggaaatacattttgaccgaggagaaaagtattcctgcggaaagcccacctgcgccgtgggctgtgactgcgaccggtatatagaggtttggaaccttgtgttcacccagtttgattccgacggcaagggaaattatacccctcttgatcatcccaatattgataccggaatgggtctcgaacgcctggcctgcgttatgcagggggtggataaccttttcgaggtcgatacggtgcagaaaattatgaagcacataagcggaattgccggagtcacatataagcaggacgccaaaaccgatgtttctctccgtgttataaccgaccacatccgttcgacaaccatgatgatcggggacggagttatgccttcgaacgagggtagaggatatgttttgcgccggcttatccgccgtgctgcaagacacggccgtctgctcggcattgaccgacccttcctttcggaggtggtttctactgttattgaggaaaacaaggcatatcccgagcttgccgagaaaaaagaccttattatccgggtggtaagggaagaggaggagagcttcggacgcaccattgacaagggtatgcagctgcttaatgagcttacccaaacctccaaggccaaggaaatttccggagccgacgcttttaagctttatgatacctacggattcccacttgatttgaccaaggatattctcgaggaaaagggaatgacggttgacgagcagagctttgaagagctcatggaggagcaaaaacagcgtgccagagacgcccgtaaaaatgccggagccgaggcatgggacgacggcggagtgcagcttgatgtcgaaaagaccgagttcgttggatacgacaccctgaattgtgacggaaggatagaggtcattgtaaacgggggcgaaaagtctgcccttgccaccgagggagagaacgctgttattatactgaataaaacaccgttttacggagaaagcggcggtcaggcaggcgactgcggcaggctgacaaacgggcgcggaggaatattccgtgtcgaaacaaccgcaaagaacgcccagggagttatccttcatataggcaaggtggaaaggggaacctttgagctttcggataatgtcacggccgag

SEQ ID NO: 3005 - DNA, 876 bp, Unknown
  Description of Unknown: Clostridiales sequence
ggtgccgccgacccggcatatctgaccgcatcctctggcaatgtggcggcttcttccgaatatgacgaaaccctgccggaaaacggtattgccggtcagtctctttacatgggagacagtgatgacggcgagaccgtttcggtcacctggacggtaaatattgcaaatgacggtctttttgtcatcgatatgctctattataccgttcccggaaagaacaattccattgaacgctccctgtatattgacgacaaatccccctttaccgaggcgggcggtattgtttttcccagagtctggaaggattctgacgagggaattacccttgaccaggacggaaacgatattcgtgcaagctcggaagaggtaaacggctggtatgacggaaaatgtatagataccagcggaaaatacggcgagtactttaaattctacctttctgccggaacacacaccatccgtcttgaaacccaaaaagaagcggttatcttcaaccgcatctccctttcgaaggctcccacccttatttcctatgccgagcttcagcagcagtatgccgaaaagggatataagctgggaacatccagcgcaaacgattatgccctcggaataaaggacgaggaggccaagaacaatcccatgcgccgtcaggccgaggatatgcatcttaagtcttcggccacaatatatcccgaatgggatcggacctctcccttgacctatccctcctcatccgatgttatcaagcttaatcagataaagagcgataagttcagcgccgcataccagtggattgaatgggagttcgacgtggaggaggccggactttacaacattaacgcccgttttaaacagacagaccgtgacggtgcattc

SEQ ID NO: 3006 - DNA, 2109 bp, Unknown
  Description of Unknown: Clostridiales sequence
aaccccgatcttgcacaaaaatattccacccgaataatccgaatgctggacggcgagataacgggggattcggctcctctttctgaaacagaggtttccgacgaaagaaaagaggacggccacaagcttgaagcgaccgtcaaatcaggcaaaaagcaaaagaagccctccatgtctttggggacatccttcggcctttcgcttaaaaacctgtttaccaagaagggacggacggcgctgacatcttttgccggaagcatcggaattatcggaattgctctgattttcgccgtttcccaaggcatgacaacttacataaatacgattcaggaggaaaccctttcttcctatcccctgacgctggaagccaaccacatggatatgggcacccttatggaaacctttatggggaaagcccaaacctccggccagcatgaaaacgatgcggtttatcaaaaatccatgatgtatgagatgataaattccctgaacagcatggaaactaaggaaaatgacctgaaatcctttaaggaatatgtcgaaaccgagcgtgccgaccaaaacagcacctccggcctgagagacgctgtgaacggtgttcagtatacctacgatatggatatgctggtatataccaaagataccgacggaaccatcatccggtctgacacaaaagctcttttgcaggatattctgcttgaatatttcggcatggatatgagcggaatgatgggatttggtgaagaaaccggcattatgagcagtatgcagaccatgtcgggcttggccaccggctcgtctgttgttctgtggcaggaaatgcttgcgggagacaacggaaaactcataagtccggttcttgaaaaacagtacgaccttttgtacggtgcatggccgactcggtatgatgaaattgtgctggtagttgacgaaaacaacgaactggacgatatgaccctttacgctctcggacttaaatccaaagacgatattgacagggtggttgatgcggcatttgataaaaccgaacttgaaattgaagaacataaatggagctatgaggaaatctgcaacatggaattccgctcggttttaaattccgactgctacaagcttgatgaaaacacggggctttataccgattttagagaaaccgacgcaggacttaggtacctgtatgacaacggaatttccctaaaggtgtcgggtattatccgccctgctgaggattctgtctcctccatgctttccggctctatcggatatacaagcaagcttaccgaatatgtaattgaacattcaaaagagtctccggcggtgaacgctcagctttccgacccctctaccgatatttttaccgggcttccctttaaagaaacaaccggaaaccttaccgaagaacaaaaggaaaccgaattcagaaactatatttcaaaccttgatgaaagcggcaaggccgatgcctacacaaagattatgagcattcctcaaaaggaacaggttgaagctgccgtcagccagaccctttctgccatgacccgggaggatatggaagcgaaaatgaccgttgctttgaccgaacagatgggaatgagcgagggcgacatcaaagcatatatctcggccatgagcgacgacgagatgaaagagctgttttccgaaatgatttcacagcagttcaagacccggtatgccgaacaggtcaaatcacagctttcggtcatgtcctccgcacagcttgcgggagccttagacatggctgtgcagggctatacgacgcagcagtgtgccgaatattacgatgaggtgctggaattttccgactcggattatgaaagcaatttaagtgaactcggttatgttgaccttgacagccccgcaaccatcaatctgtatgcttcaagctttgaaaacaagaatgttatcgaggacgcaatcgcggcatataacgacacggtagacgaccttgaggaaatacagtataccgattatgtgggcattatgatgacctcggtcaccactattataaatgccattacatatgttcttatggcttttgtggctgtttcgcttattgtttcctccattatgattggagtaattaccctg

SEQ ID NO: 3007 - DNA, 1290 bp, Unknown
  Description of Unknown: Clostridiales sequence
gagcgcatgacggcggtcagacttgaactcagcaaaaaaatttcccactcctttaagctccgcctcgccgggctcttaaaggtggaagaatatcagatttttacagaccgttgccccataaacaccgagtatgcttatgaactcataaaaaagctccctaaggaaatatcaaagccccttctttatcggccgtatgaaggacgctcacccaaggaaatacctgacgggaggagtgtacttaagcagataaaacaaggggataaactgcttttttacccctatgattcggtggaaacctttctcaaattcttaaacaatgcggcagacgacccaaacgtttgttctgtaaaaattacaatttaccggttggccgcccattccaaaattgtccacaccctttgccgagcggcggaaaacggcaaggaggtggtggttattatagaactgagggcccgttttgaagagcaaaagaatcttaaatgggcgaaaaccatggaacggtcgggatgccgtgttatttacggtgtaaaaggacttaaatgtcactgtaaaatatgtctcgtcacccttaaaagagagggggaaatcgggtatatcacgcagattggcacgggaaattataatgaacaaaccagcgccttatataccgacctgagcctgatgaccggcgatttaaatataggaaaggatgcttccgatttttttgacagtatgctgaacctcaagccaaagagcgtataccgccggcttgccttttctccgcttggtataaaaagtctgctttttgaaaagattgaccagcaaattcggttgggaaacagaggatatatatgtataaaggccaactcggttaccgagcgggatgttatcgacaagctgagggaggcgtcccgagccggggtggaggtgcagcttattgttcggggcatttgctgtattttgcctggaatttcgggacataccgacaacattcatgtaacaagcatagtcggacgttatcttgaacacgcacgggtttatttgttcggtaaagaccgggagcagtcggtttatatttcatcggctgacctgatgacccgaaatctcaaccggcgtattgaaattgcctgccctgttcatgacccgatcctccaaaggagacttaaacagatgctcgactgtcagcttttggattcggtcaaagcccggactatgctttcggacggaagctatgtcataaacaaaagcgataacccctttgattcacaggcatatttcatggaaaagcattcccccaaccctgagccttaa

SEQ ID NO: 3008 - DNA, 651 bp, Unknown
  Description of Unknown: Clostridiales sequence
atgaaactcagaccccctgccttccctcttatcaccgtcgacccatacttttcggtttggtcccacagcgatgagctttattcctccgacacggttcactggaccgacgacccaaaccccttaaaaggcaccgtcacggtagacggcgagaccttcagatttatgggaatgacaaaagacccggaaattaaacagatttacagcgacctttcggcccttgtgaccgactatgtttttgaaaacgacaagattattcttcatttgagcttttactccaccctttttcccaatgacctttaccgtctctcccgaccggtttcctatcttcaaatcacctatgattcaaacgacggcaaaagtcacgatgtttttgtagacatttccgcctcggaggagctttgcatacacaaggccggagaaacccccgtcctcgcccagggcgtcgagctttgcgacggccaaaaggccattaaaatcggcagcgtttaccagaaaatgcttcagcgcagcggcgatgtgctcagaatcgaatggggatacttttatctctgcggaccaagcggcgccgaatacaaaagctttgaggatgagggaaaaacctttatttcaacgaaattctcccttacagagggcaagggaagctgtctgctt

SEQ ID NO: 3009 - DNA, 513 bp, Unknown
  Description of Unknown: Clostridiales sequence
atgaataaaaagctaagaagcgccgttattgccggcaactggaaaatgaacaaaaccccttccgaggccaaggctctcattgaggagtccaagcctctgctcgaaaaggccgaatgcggagttgtaatgtgcgttccctttgtggatctgcccaccgcgctcgaggccgccaagggcaccaacattaaaatcggcgcccagaactgtcattttgaaaagtccggcgccttcaccggagagatttctgcccctatgctcaaagagatgggagttgaatatgtaattctcggacacagcgagcgccgcacctatttcggcgatactgacgagacggttgcaaagcgccttaaagccgctcttagcagtggacttaaagttatactctgcgtgggcgaatacaaggaacagcgtgagcagggcattactgccgagcttgtggccatgcaggtgaaaattgctcttctcggtctgacccaagaggaaattaaaaatgttattgtcgcctatgagccc

SEQ ID NO: 3010 - DNA, 975 bp, Unknown
  Description of Unknown: Clostridiales sequence
aagaaaggaaaacttcgcggagtggaatccaacggtatgctctgctcgggcgaggagctttgccttaaggaagaggattataagggtgctgaggtctacggaattctcattcttaaggaagggactcctgtgggcgtggacatgcgggaaattcttaaacttttcgattatgttatcgattttaaaattactgccaaccgtcccgactgccagagtgttctgggcgttgcaagagaggtttcggtcgtgctcggaaagcccttccatcctcccgttccggaatacaaaaccgtgggcggcgacataaacgattacatcaagattgatgtcgaagactatgatctctgcaaccgttattacggacgtgtggtcagaaatctgagaattaaagagtctcccgactggatgaagcgctgtctcaaatcggccggcatgagacctataaataacattgttgacattacaaatttcgtaatgcttgaaaccggtcagcccatgcacgcctttgaccgacgggatataaaggataaccgcatcatagtccgccgagccgctcagggagagaaaataaccacccttgacggaaaagatcatgttctcaccagtgaaatgcttgttattgccgacggaaaagctccctcctgccttgcgggaattatgggagggcttgacagcgaaatcaaggatgacaccaccgaacttttccttgaaagtgcaaagtttcgccgtgacagcgtcagaaaaacagcacgtgcactcggtatgagaaccgaatccagctcccgttttgagcgaggactggacattatgaatgtggaatttgccatggagcgtgctcttcagctcattaacgaccttgacgcaggggatattatagacggcgttatcgacaaaaacatgggtcttccgacgccccgtgttcttaccgttcctgcacaaagcataaacgaccttctgggggttgaggttcccttt

SEQ ID NO: 3011 - DNA, 1893 bp, Unknown
  Description of Unknown: Clostridiales sequence
atggcaaggtcgggggatattcagggggcgcttgaaaggtttgaaggcttcatacgctcctttctcgacccccatatgtttgacgacctggaggttggagtcggaggggtggactgtataaacaccgacacccccatcgaggcggccgacagggctctcaggcacgattttgtgtcctgcggcgtggagcatcagtttgacagcgagacggtcgactggctgcacaatcccacccccgacagctatcgggaattcacctggcagtttcagcggcatcacgagtttttttatcttatgaacgcctaccgggtgacgggagacgaaaagtatgcaaggggctttaaggagcttataatgagctggataatgcaggcttctcccgctcctctggatgtaaccggcggtgagaccgatttctggcggaccattgaatgcggtattcgaatgctgggaagctggccggtttccatatgcaccttttcctcctcattaagccttgacggacgggactgggtgaatatctttaagtgcgtctacgaacacgccctgaggctcgaaaaacagttcacaacctccaactggctcattatggaaatgaacggactggtccacatcggccttctttttccctttttcaaaagggcgaaggattgggaaaattttgccatggacaagctgtttgaacagcttgacgcccagatttttgccgacggatttcagcaggagctgaccaccaactatcatcaggtggtggtaaacaattatgaggatgtgctccttatctataaaaagaccggtaaacagcctaaaaaggagatgcttgccgcccttgaaagcatgtataatgtctatccccacattgtcaagcccgaccttaatgttccaaatttaaacgacggcgccgactttaacacctccttaacccttgccagagccaccgacttcttcccccaaagagaggattttctctacctgaaaaccggtcgaaaggagggaaaggagccggagattctttcaaatattctgccctattcgggatatgtcaccttccgaagcgactggagtaaagacgccttttggtgtttgttcaatgccgcccgattcggcttcggtcatcagcacgaggacaagcttgaggtacttatacatgcctacggcgaatatcttcttcccgaggcgggacgcgccgcctatgacgggtcaaagctctttaactattctctgctcacaaacggtcacaataccgtcatgaccgacggcctttcccagcgctgccgagaccacagcaggtgggacccggccgtgctaaataccccggccgatgtatattttaattctcaggattattttgactgtgccgaggcctgctatgaccaaaattacggggagcaaaatgttaaggtcaaacacaaccgccgggtcatatggcttaaaaatcccgaaggcacaaatcccctggtggtgacggtggacagaatgtataatctggaggattatttgcataaatacaccgccatatggcattttgccgacggggattataatttttccgacagggaattctcggtaaagacccaaagcggcgtgggtataaagatgatacacaccctcgacagcacgcaggtctaccgtgcagacggcgaccgcttacagggatttcggtgtaacgaggtgccgggtaaattctggcctctgcccacagccgaatgtgaaatttcgggcggggacgtgagatttgtgaccgtctttgagccctcaagcaacggggaatataacatttcctcggttgaggccgagaccgatattgaggccgacaagattcttattcatcttgaaaacggacggacggtacggcttaacgagtcggactatttttgcgaaaagctgaaataa

SEQ ID NO: 3012 - DNA, 849 bp, Unknown
  Description of Unknown: Clostridiales sequence
atgtcattttttcaaggattgtttttgggtgtgattcagggtctggctgaatttttgccggtttcaagcagcggtcatttaagtcttttccagcatcttttcggtcttgacccaaacaacaacctttttattaccgttatgatgcatttgggaactcttgcggcggtttttattgtttactataaggtcatctggaagctcgttaaggaatttgtcttttcggtcagagatatttgcaccggtcaattcagctttaaaggaatgaatcattaccgcagaatgatggttatgatacttatttccacccttttgcttgttttcatggttcttccggtcttcggggggtactctctaaaggacggtgccgaagccataaacaattccaagagcattatccccctcggaattgcctttatgactacaggagctttccttgtcataacctttaaaattttcaatacatacaaaaaaacgagaaacggcgccaaggttaaggatgcccttattatcggaggtgctcaatgtgttgccactatatcgggaatttcccgctcaggttcgaccgtatgtgccggccttctttgcggactgagcagggaatatatggtggagtattcctttataatgagcattcccgtgattcttgcttcggccctgagcgaaggtaaggatgcccttgaggttggcgttgatgttcagcttgctcctctttttgcgggaatttttgcggcgctcatttcgggaattgccgctataaagcttatacagtggcttatccgcaaggacagatacaagcttttcggctactactgccttgtcatcggcgttattacacttgttctcggagtg

SEQ ID NO: 3013 - DNA, 1473 bp, Unknown
  Description of Unknown: Clostridiales sequence
atggacggtttcggaataaattccgctcacaaaaacaatgcaatctattcggccaagacacccaatcttgacagatttatgagcatttatccccatacacaaataggcgcatccggaatggatgtcggtcttcccaacggccagatgggcaacagcgaggtcggacacacaaacatcggagccggccgtgtagtctatcaggaacttacccgcataaccaaatccatttccgacggcgacttttttgaaaatcccgtgctcaccggcgctatggataactgccttgaaaagggaacggccctgcatcttgcgggacttctttcggacggcggcgtccacagtcacaacacccatctttggggacttcttgagcttgctaagaaaaagggaataaaaaaggtttatattcacgctctgcttgacggcagagatgttcctccggcttcgggcatagaatatgtcaaggaagcatataaaaagcttgaggagatcggcgtgggacagcttgctaccatggccggacgctattacggaatggaccgtgacacccagtggggaagggtacaaaaggcgtatgatgccattgcaaagggcaatggtcttaaggccgactgtcctgtcaaggcattggaaaattcttatgccacaaaggacgaggacggaaaattcattaccgacgagtttgtaatcccaaccgtcatcggagattataagggaattgaaaaggatgattcctttatattcttcaatttccgtcccgaccgtgcgagagaaattacccgtgcttttgtcgaccctgagtttgccggctttgaaagggagcttgttccgctttattatgtctgcatgaccgaatatgatgccaccatgccgaatgtcaaggttgcatttgctcccgaagagcttaaaatgaccatgggagagacactttcaaaggcgggcctgacccagcttaggattgccgaaaccacaaagtatgcccatgtgacatttttctttaacggcggcgaggaggtaaaatttgagggtgaggaccgcattctcattcccacccccgatgtatccaccttcgaccttaaacccgaaatgagtgcgtatcccgtttgcgacgccgtttgcgaggccatcgagagcggaaagtatgatgtggttattctgaattttgccaactgcgacatggtaggacataccggagttttcgacgcggctgtaaaggcggttgaaacggttgacgaatgtgttggcagggtggtggagtcaacgctgaaaatgggcggagtgacccttattaccgccgaccacggcaatgccgactgtatggcgtcggaggacggtacaccctttaccgctcacaccaccaaccctgttccctttatagtctgcggctatgactgtgaactcagagagggtggcagacttgccgatatatctcctacaatgctaaagatccttgggattgaacagcccgaggaa

SEQ ID NO: 3014 - DNA, 849 bp, Unknown
  Description of Unknown: Clostridiales sequence
gcagaggctcagggacttaaggtcatgaccagcgaccgggccgctaaagccgcagacattatcatgattctcattaacgacgaaaagcaggccaagctttataaagagtcgattgaaccctacatgaccgaaggcaaaacacttgccttcgcccacggctttaacattcatttcggctgtattaagcctcccaagaatgtcaacgtcattatgattgcccccaagggccccggtcacaccgtccgcagcgagtaccaggccggcaagggtgttccctgccttgtggccgttgaacaggacgccacaggcgacgctttggacattgcccttgcatatgctctcggtatcggcggcgcaagagccggagtgctggaaaccaccttccgcaccgagaccgaaaccgacctcttcggagagcaggcggttctgtgcggcggcgtctgcgccctcatgcaggccggctatgaaacccttgttgaggcgggttatgatccgaggaacgcatactttgaatgtatccacgaaatgaagcttattgtcgaccttatctaccagagcggctttgccggaatgagatattccatatccaacactgccgaatacggcgattacatcaccggtcccaaaatcattaccgaggacaccaaaaaggccatgaagcagatactcaaagacattcaggacggttcctttgccaaggaattccttcttgacatgtcatccgcaggcggtcaggttcactttaacgccatgagaaagcttgcaagcgagcatccctccgaggttgtgggcaccgacattcgcaagctttacagctggagcgacgaggacaagcttatcaataactga

SEQ ID NO: 3015 - DNA, 744 bp, Unknown
  Description of Unknown: Clostridiales sequence
cagtattattttaagcgtcacggactttacggatattatgacgatgcagagcgttttgcctttttctcccgggccattctcgaaatgctgccggctattggttttttccccgatattatccattgcaacgactggcagaccgcccttgtgcccacctatctgagccttttctaccgtcaaattccccggtacgggaatataaagaccgtgatgaccattcacaacattcagtatcagggaaaatacggaatggaaattcttgaggatgtgcttggtatacccttggatcaaaagccgcttcttgaatacagcggggatgtgaatattttaaagggcggtatcgagacggcacaaatggtcaccaccgtcagtcccacctattcaagggagattctcgacccatggttttcctacggaatgcacgacattttaaaactcaggagctggaagcttcacggaattgtcaacggaattgacacaaagggttatgatccggaaaatgacgaaaggatttttgctcccttctctgccgaggatatgaccggcaagaaaaaaaataaagccgagcttcaaaaggccatgggacttcctcaaaaccccgatgttgctctggtcggaatggtcagccggcttgtgggacacaagggatttgaccttgtgaaatacgcctttgaggaacttatgcaaagcgaaattcagcttgtcatgctgggctcgggggaatgggtctttgaaagctttttc

SEQ ID NO: 3016 - DNA, 669 bp, Unknown
  Description of Unknown: Clostridiales sequence
atgagcggccaaaaaaaagtcgttttaaacgacgatttcgtaagtcaaaatatgggtcttgttcatgcctgctgtcataagttagagggcaggggaattgaatatgacgagcttttttcggccggctgccttggcctttgcaaggcggtgaagggttttgacaatgaacggggttcccggttttccacatatgccgtaccggttattctcggagagataaagcggctttttcgggacggcggaacggtcaaggtgggcagaaccataaaggaacggtctcttgccctcatgaaaataaaggacggcctcaccctaaagctcaaaagagaaccgaccttaagcgagctttcgttcgaatcaggcttttcggtcgaacaggtttcggaggccattgccgcctcggcgccggtgctttcgctgactcgggaggaaggggagaacggtcaaaacgacattacggtcgaaggagaggaaaacagcataatttccaaaatgtcccttttacaggcccttgaccggcttgatgaggacgaaagagagctcataaggctgagatattttgaggaaataacccaaaacgatgccgcaaaaaagctttgcaccaatcaggctcagatctcccgacgggaaaaggcaatacttttaaagctcagaaaacagcttacataa

SEQ ID NO: 3017 - DNA, 1950 bp, Unknown
  Description of Unknown: Clostridiales sequence
atggaaatcgaacagatgccgagcgttaaggtaaaggaagaatacgacgccgaacaaattcaggtgcttgaggggcttgaagccgtccgaaagcgcccgggtatgtatatcggctcgaccggcgaaagagggcttcatcatctggtttatgaaattgttgataactccatagatgaggctctggccggatactgtacccatatcgaggtcgacattctcgaaggggacattatctgtgttaccgacaacggacgaggaatccccaccggaataaataaaaaatacgacatgccggctgtcaccatggttttcaccatgcttcacgcaggcggaaagttcggcggaagcggctacaaggtttcaggcggacttcacggcgtgggttcttcggttgtaaacgccctttccacatggcttgaggtggaggtcaaaaacggccgggatattgtcagacagcgatatgagcggggaaatatcgtgaccgatcttgaaaaaatcggcgaaacaaatgaaaccggaacaaaggttaccttcaaacccgacccggaggtctttaccgataccacagaatatgattacgacacactgctcacaagactcagagagcaggcgtttcttaacgccggtgtcaaaataaccctgaccgaccgccgtcccgacgaggagggcaacgtccaggcgagacaggatgtgcttcactatgaaggcggtataaaaagctatgttgactttattctcgaaagatcaaaaaaagagcccttgctccccgaggttgtatatataaacggagtcaagggagattcgtcggccgaaatcgcttttcagtataataacggctatgacagcaaaattatcagttttgcaaacaacatccatacggtagacggcggaacccacgaaagcgcatttaaaaccgctcttacccgtgtggttaacgcctatgcccgcaagttcggacttttaaaggaaaaggatttgaatttaaaaggagaggacattcaagaggggattgccgccgtcatttcggtcaagctgaccgacgcccagtttgagggtcaaaccaaggcaaagctgggcaacacctccatgggcaccatggttactgccatggtgggagaaaagttggccgaataccttgaagaaaaccccgtgccggcaaagataatcgttaacaaggccattgccgcttcagccgcccgtgaggctgctcaaaaggcaagagaccttaccagaaaaaacagcggaaataagtttaaaaagcccgaaaagcttgccgactgtatttcccgagacccgtcagaaaccgaaatattcatcgtcgagggagacagcgcgggcggttcggccgtcaagggaagagactcaagaacacaggctattttgcccctttggggaaagatgcttaatgttgaaaaggcccgtgccgacaaggtatacggcaacgataagctgaccccggtggttttggctctgggaaccggtatcggcgaggagtttgacatttcaaagctcagatacggcaaaatctttattatggccgatgccgatgtagacggctcccatatacgcacgctgctgttgacctttttctttaaatatatgcccgagcttatagaaaacggcaatatttatattgcccagccgcccctttttaaggtgtcaaagggaaagaaatttttctatgccttctctgacgaggaaagagacatgtatattgagcagcttggcggaaacgccgatgttcagcgatataaaggtctcggtgagatggacggagcccagctcaacgaaaccaccatggaccccagataccgcaccacccttcgcgtgacaatggaggacgcccaaaaggcggccgaaaccataacccttcttatgggcgacgaggtcgaacccagacgtcagtttatcgaagaaaacgccacctatgttcaaaatcttgacgtataa

SEQ ID NO: 3018 - DNA, 888 bp, Unknown
  Description of Unknown: Clostridiales sequence
atttacatatattccgaagaggagctgaccaccggtcatattgacatagcgctgctcagctcttcggaatttgaagacggatataatttccgccgtcactgtaattttaaaaaaggtttgaacgaaatttatttttctaagaccgagcttgtttgtgcttttaagcttaatgccgacctttccgatataaacgcggtctgcataaagtgggtgaatgacgatcaggtcgatgttaaggccgatctttattttgacgcccttcagggagttttggccgaaaatattaaggacgaaaatttcggaagcaccttaaccctcgaggagggcaaggaatataaggtcaaggaatatcgccgcattatgagttttcaaactcccgatttaagatacaaaaatcttcagggaggatattacgacggctctcagtttgtgctgtgcataaccaaaggaagtatgcgccagaacaacgaaagcggaattattgccaaatatgacaatgccggaaatcttttgcaaacgagcgatgatttgcccattgagcacggaaacaacattacctttgtgccaaagaaaaacgcctttatcgtctctcattgtcagcccggctggaatgtttattccaccattgacgctgacaccttgagagaactctcgtcaggagctcttgagaggaatttcttttccattgcatattgcccggcaaccgatatgtttgcttcgggttttgcagggggagaaatgatacacacctggaacggggatatgagtcttgcaaacgagttcaatgttgaacagccttcatccctttctcagggagccttctgtgacagcaagtatatctactttgtccgttcgtataacaacggcgatacctggtcggaaatccgc

SEQ ID NO: 3019 - DNA, 987 bp, Unknown
  Description of Unknown: Clostridiales sequence
atggcaataggtatagaaacagttttgctcatagcggcagcccttatagttataatacttcttctggtcaacatccgtatagttccccaggcttcggaatttgtcatcgaacgccttggaaaatacaagcacacctggggtcccggcatacatgtaaaaatcccctttttggacagaatcgcaaagaccataaccttaaaggaacacgtgctcgactcccctccccagccggtcataaccaaagacaatgtaaccatgcagatagatacggttgtttattacaccatttttgactcaaagctgttcacctacggagcggtcaatcccattagcgcccttgaaaatctcacggctaccaccctgagaaacatcgtaggcgagctggagcttgacggaaccctcacctcaagagacaccataaacggcaagatgacctccattctcgacgaagccaccgacaaatggggaattaaggtcaaccgagtcgagcttaaaaacatcattcctcccgccgaaatacaaaatgccatggaaaagcaaatgaaggccgagcgtgacaaacgtcagaccctactcgaagccgaggctcacaaggcggcggccattacccgtgccgaaggcgacaaggcggctatgatacttgccgcagaaggtgaaagagacgcccggattgcccgtgccgagggtgaggcaaaggccgtaaagctggccaaagaagccgaggccgaaggtcttaaaatgcttaaggaagcctgccccgattcggcggttttggaacttaaaaaatacgaatccctcgttaaactttcagacggcaaggcggccaagataatcattcccaccgacgcggttaacgccgtaaagtcaaatgttatcttttccgaaaccaccgggctcggaagctccacctcccccgcccccgaaaagccccaaatccctaaaaccgaccaatgctgtgaacggcttgaaagcaagggtaatttctaa

SEQ ID NO: 3020 - DNA, 1329 bp, Unknown
  Description of Unknown: Clostridiales sequence
gtgagagaattgctttttgacgtagcaaagccggttaaacgggctcacggaggggtgcgggctcctcacaagaaatttaccgccgagcaaagcacggttaaaatgccgcctccccaaaaggtctacatttccatgcagcagcacattggcgccccctgccttcccaccgtacaaaagggtgataccgtttttgtcggtaccgttgtgggagacagcgacaagtttgtctcggctcctgtacattccagcgtttccggaacggtggagggcatgacaaaaatccagctcccctcgggagccaaggccgatgccgtggtcattgcctctgacgggctgatgacccccgaccctaatttgacgccccatccgataaagaacactcaggaccttataaaggccgctcgggactcgggtcttgtgggtcttggcggggcgggattccccacctacataaagctcaccccaaacaaggataagcccatcgacacggtcattatcaatgccgccgagtgcgaaccgtttataaccgccgattaccgtgaggttattgaaaacagcgacaaaatcatggagggggttttcctccttcttgacatattaaagcccgagcagataataattgccgtggaggataacaagcctgccgccatcgaaattctggaaaagattgcggccgaccgacgggattcggacaatcaggtcaaaatcatgaagcttcgttcccgctatcctcagggcgccgaaaaggttctggtttatacggtcaccggccgaaaaattcctcagggaggtcttcctgcagacgtgggctgtattgtcatgaacatcaccagcgtttccaagctgtatgaatacatcacaaccggcatgcctcttgtcagcaagcggctgaccgtcgacagcgccgcccttaaaaaaagcgccgaaaacgtaatcgttcccataggaacgccggtggaagaggtggtcggatttgtgggagaacccgaacgggaaattacaaaggtgcttatgggcggtcccatgatgggcctttgcattgccgacgggcaaattcccgttttaaagcaaaataacgccattattctttttgctaaaaacaaggattcctccctgcgatataaagaaacagcctgtattcgttgcggcagatgcggcgaagtatgccccatgtcgctactgccaacatccattgaaaaatattcccgtctcaaagacattaaatccttggagaaggcgggcgttatgacctgtatggaatgcggaagctgtgcctttacctgccccgctcaccgaccccttgtccagtacatgcggctggccaaagat

SEQ ID NO: 3021 - DNA, 1296 bp, Unknown
  Description of Unknown: Clostridiales sequence
gtgcagtatgacaccttggactgtaataccgtgaaatccgaatggtataatgcctgggatattgattatctttattatatctcatcctatggggtgctgacagcggtcgagctttttgaaaatcttaatatgcctatcggttttatcaactccactatcggtgccaccggaattgaagcgtggatgtcaaaggacgccattaacagcagcgaaactgtggttaatacccttaaaaaatacggaaaatattatgacacaaaagacagtttccggtttgaccagatgagcggaagctggaataccaggcttggccccttgtgccgacttaatattgccggatttatgtggtatcagggatgctccaatcttgagaacggtctggtcagcgatgccggattttaccaagccgctcttgatgcatttataaatgatttggcttctaaattcggtttttcaagcgtaaacgatatgccgtttatcatgacccagcttgcggccgacgcttacaaattctcaaacgactctttgcccatttggaccgaagaagtgacaagggttgtcaacaaataccccctcgcccagcagataaccttttatgacgccagtctggtttatcaccgggatggctgcaccggagatccctgcacctgtggaaacggtatagaccatccaagtgataagcgtaccattgcccaccgcacggcccaggcaatgctccacaacatttaccgtatagagggaacaacccccgattactacatccccgaggtcgagtcatatgagatcgggcaaaacggaaagataatcgtaacctttaaaaatgtcggaagcgggctttcggtcataaccggtgagtccaccgatgaaagaagtttggccttgtcggacgaggtggaaggctttacggtgtgcggagaaaatcatatttatgcccctgccagagctcggattatttcacaaaatcaggtggaggtttataacagcctgataaaagatcccgtggcctttacctatgcctttaccaactttaatgtctgctcggatctttgcaattcttacggacttcctgcactccagtaccgcagccatagctttgaggacgcatataactgtactcctatcgactgggcaacctgtgaccacactcttttctgggacaccaatcgccgcgacggatattacgttcctaactgggtagtaggaagcctcacaggtgaaaccgaaccgaccggcgggacaataaaggtcaatcccgaggttagaatgcagggtcagggctcgattgaatttgattat

SEQ ID NO: 3022 - DNA, 1467 bp, Unknown
  Description of Unknown: Clostridiales sequence
ggatatcagagtgacaagtattatgaagctcttaaaaatgtcgacaaaaatgtgggagcgatgtatgacgccctcgcaaacctcggttatcttgaggataccctgtttattatactgaccgaccacggcggggtggggaccaaccatggcggcaacacccaaaaggaaatgaactgcacctatattgcaaagggaaagagcattgtccccggcgaatataaaaatccggcgactaacgatgtgctgaccacagcaagcttgtcgtcggtggtggcggcggcactcggaatcgagcagagcggagattatgattataccgttcccgacaactatttcaaaaattacacctattccgcccctcaaaataacgaatggcaggttgacacccccggtaagtattatcgccatcacaccacaaccgacaattccgacggacaaattaagctttcggactatatggacaccagcgagcttaatctcaaggcatatttcaagtttgacggcaatcttgacaatgctcagccttcgataatttcggccaccgccaacgacaccgtcacctttgacgacaacggttattttaacggtgcagccgatcttacaaacggctatttgaccgtcgacgggcttaaaaatctcggctccgacagcttttcgatttctttttggctcaaggatttaaatgttccttccggagatccggcgctcatatgcaacaaggactgggaaagcggacttaaccccggcattaccattgcaagcgaaaacggaagattccgctttaatctttccgacggttccacccgctcggacaccccttatgtttcggccaacggctatgaaaccaacggtagcggcggatttgtcaacattatcgccgtggtcgaccgccaaaccggcatagcttccctttatgccgactttaggctgatcgcaacagccgaacttactatgggctctcttgaccctgccgccggggccaccatggttatcggacgggacggaatgaaggcgggttttaaaccggaattcaagattgacgaattcatgttcttcggttcggctctgaataccgaagatattcataatcttcaggcatactatgacaccggaattaccgatcccgacaacgaaaccgccgtcagggcgctggaaaaggttaacgagacctacggtctgataaaggccatcggagaggtcactgccgataactggagagaaaagaccgaggccattaagtccgcaaccgacgctctttccgagcttaaggcaaatttcggtgaccgtcatatcgataatcttcccctttatgaaaaggcggttgaagactatgaaaaatataaggtggatattttgcccggcgatgtaaatctggacggtcaattggagatcaacgatgcacttatgaccctccagcattcggtcaaaaagataaccctcaccggagacgctcttacggccgcaaag

SEQ ID NO: 3023 - DNA, 777 bp, Unknown
  Description of Unknown: Clostridiales sequence
gaaacccaaaaaggcgagaaaatatcggccgaactttcctcccgtcttgccgcggttgagggtgcaaaggccgagcgcaccaccgcaaacgaagataagataagggctctttccgagcttaaaaggttgaatgaaaatatccaaagcggacgggcggctctggccgaaattgaagatgaacggcaaaaggccgccgaccgaatcgccgagctgaaaaaatcagccgccgacgcagaccaggcagtggagtctcttaagaaacagcttgacgagcgccggggctgtcttgacaatctttctaaggagtcggaagaactttcaaagcgcagggaaaaactgctcatggagaattcggccgtccgagtgaccatactgtcccttgaaaacgaggcagaggcggttaaaatgggcatcgattccataaatgccagaaaaaccgacgccataaatgcaaaaactgccatggaatcccgcataagcgagcttgaagaggcaaactctgccgaaaatcttcaaatagaaaagcttaagggtgaaatcgtcgagctgagagaaagggcggcgcaaagcagggaaagatccgaacaaaagcttgaagagcgcacccgtcttgaggccgaaatttcggctttgacggccgaagaaagggacctttcggcccggaaggaacggctttccagcgaggtcaccaggctgaccgagcgccgggataacatgcagaaggagcaggaaagcgttgttgccaagctgtttgataaatatgagctgaccgtaacg

SEQ ID NO: 3024 - DNA, 663 bp, Unknown
  Description of Unknown: Clostridiales sequence
ttggaggaacaaaaaatgaaaatctttctcgacagcgcaaatatcgagcagattaaaaccgcttacgatatgggcgccatcaccggtgtaaccaccaacccctcgatcatttcgagagaaaacagaaaatttgacgatcttcttaccgacatcaccgccatcatgaccgacggccccgtttttgccgaggttttaagcgtagatgccgagggcatgatcgaagagggcagaaagcttgccaaaaagagcaagaacattgttgttaaaatccccatgattcccgaaggactcaaggctgtcaagaccctttcttccgagggtatcacggtatgcaataccgtagtgttctcctcctgccaggcaatcctcgccgccaacgcaggtgcttcctatgttgctccttttgtcggacgtatggatgacatcggtgaaaacggactcaacctcgtttccgaaatcagagaaatttttgacgctcagggtatcgacaccaagattgttgccgcttctgtccgtcatcccgttcatgttgccgagcttgccagaatgggcaccgacattgcaaccatgcccttcaaggtggtaatgcagatggctaccaaccccaactccgccagagccgttgaaggcttcctcaaggactgggaaaaggttcctaaataa

SEQ ID NO: 3025 - DNA, 2169 bp, Unknown
  Description of Unknown: Clostridiales sequence
atgaaaagaattatttccattattcttgcggcagcgatggttttcagtttttcaacggtttttctcggagtgtcctttgccgaggcagaaaccgaaaagctgttgaaaattgaatatgacgggacgggagcgggtcaggtttgttatatgagacttggctggtgtacccccgaaataaaggagggcgactacctggaatacgatgtctggctgaccgacgatttggccggtgtgggcggactggattttgcaggtgaaggaagccgctattgccgagattttaacgaatacatggatgtcaacggcattaagggacatccgaaaaacgacataagcgactatgcttaccaaaaatggtattcgaggaaggtgaaattggcctcggttgtcaacggaacttctgacaactttgtcattgtcgcctttgagggtcttaccgcaaaaaccacggcatatttcgacaacatccgcataacccgagacgatgaggtgctggaatatgcctttaaggacggcggaacagagtaccgatatataggaagtcactatgccggaatcgaaaataagataacggtttcgacggttgaaaaaagcgctgtcggtcttccggaaatttctcaccccgacgaggtggaggtcacaaggagtctgattgcccaaatgcccgaccgtaacagtgtaaacgacatgaacttcgagcttcttgaccgtgcggtcaaggcctttgaaaatcttaccgagggtgacaaggctttgattgacggttcggctcttgagtcggcaaacgagctttacaaagcatataaagacgccaagctgggagatgtcgaccaaggcggaacaataggagtagaagatgcgcttcttgccctccagcacgccgtgggtaaaatcactcttgacggtgtggcgcaaaaatcggcaagggttaccgaagaccggcaaatcagtgtaaacaccgcccttatgattcttcagcgcgccgtgggtaaaatcaactttttccctgttgaggacagggagctcacccttttgggtaaggacgccgaaatgaggcttgcggtgggcaggaccgaggtttcggtgacatctcttgtaaacagtgaaaacaatattaatatgataaacgagccggtggctgtttccatgcccattagttattcggcgggggataaaaccgccgagtttgactggaaacttgcgtcggtcgaggactatacctgtaccgaaagcgatgtttcgggcaatgcggctctgaccggagttaagctgacatacaccgattccgaggccggttttgattatgaaatttatgttctctcaacggatgattacgccggtcccttccagttttccgaaaagctggtaaataggaatgacagccgggtaaccgtgtcgctgtcggatttcttcaatgcctctcttgacggcagagaacagcccacagccatgaaaatccgcaccgaggggcaaacctattatgccgacggtctccaaagggttgaaatgaacgatgggatttccatagccactaacacctccacaagtcagagcggaaccgacgatgtgcccatgatttatctcgattacggagacaaaggggtttatgcggcccttgagtggccaagcggaagcatgcttgccaagcgaaaaggcgatgctgtaaagatgagcgtatattttcccaatttcaccacccgtgtcgacccacagacggcgctggaaattcccacggtttatttcggagcatatgacggcgatatcgaagagggaagcaacgcctttaagcgctggttctataacaccaagtctcccaaaatactcagagaggatcccaacgagcctttaacccagatggatatgcaggtaggcctcaatgtcgaccgtgtgggcggtatcgaatcggttaagtgggataacggctggtgggccggcgctgatcaaaaaatagtaaacggctggggaggaatcgaaggagactggaacgaggttcgcgatcccagatatatttccaccataaacgcctacggctgtgccgaccttaaagagtttgccgcactgtgcacccaaaagggtataaatctgaccacctatgttctgcttcacgatgccaagaacaacaaccccgacgcccttacctcaataggccccaacggccatcccgagtgg

SEQ ID NO: 3026 - DNA, 1452 bp, Bacteroides sp.
atgcaacagggcgaatcgacatcgatgtatcgtcgtattgtgaagacgaccgggcttttgggaggagtgcaggtgctttcgattctctgttccatcgtgcggaataaatgtattgctttgtggctgggtcctgcgggagtcggtattatcggattgtacaatacatcgatagaaatggtcgccgcccttacgggattgggattgcggcagagtgccgtgcggaatgtttctcaggctcgggcttcggaaaatgaaaatgcgttgtcgcatacggttaccgtgttgaggcgatggagttggctggccggccttttcggtgcggttgtcatgctttctactgcaccgctgttgagccgttttacatttggcgatgacaagcatatttgggggtatgtgtggttatcgtgcgctttgcttttcaatgctttgacatcgggcgatcaggcgatattgcagggaacgcagcgattgcgccagctttccaaagccggtgttgccggtaatttggcagcattgttgttgtcgttgccgctatattattttttccgattcggcggtatcgtaccgtctttggtcttgtcttcggccgttacgttttttttcgtctggatatacagtcgcagaagtgttgcaccgaaacaaccggtttctgtgcgggagacatggaatgagggaaaatgcatggtcgtcttgggagtatatatgacggtgagcggattcctgacgacattgttcaattacttatttatcggttttatccatagaacggtcggagatgccgatttgggctattatcaggcggggtatgctattgtaacgaggtatgtgggacttgttttggcggcgatggccaccgaatattatccccggttggcagccgtgagcgaagataaggaaacacttggaaatcaggtgtctcgacagatcgaggctgcgttgttgctattggcacctatcgtgtcgttgtttctgctgttgcaggagtgggtgatacggttgctttatacgtcggagttcctgtgtatagaagagtttttctcttgggcgatggtaggtgtattgttcaagtcggtttcttgggcgatgggttttgtcttgctggcgaaaggcgacggtaagttatatctgatcaccgaattgatttcggatttgtgcgggttcctgcttaacgtctccgcttattatttgtggggactggaaggtgcaggtgttgcttatttgctcaatttcgtgatttacggtatcatgatgtggtgggtgtgccggcgtcattaccatatacggttaggccggtcgtggtacggagttgccatttgggtgattgtcggttgtgcagtcgtttcgatactgtaccgcatcggttcgataccggcgttatcggtggccgtagtgtgtgctgttgcagtttctgtggcggcgttgtgggggttgaaacgtcggttggcgatatag

SEQ ID NO: 3027 - DNA, 1194 bp, Bacteroides sp.
acgaaacattccatagctgaaagagagaataccatgattacgctgagcatcgtcatcgtcaattataatgtatgcggttttctggaacagtgcctgctgtcggtacgcgatgccataaaaggtatttctcatgaaatattcgtcgtggacaatgcttcgaccgacgggtcggaagcctacatttcgacccgctttccgcaagtaaaatacatctacaacaccgaaaatgtaggtttttccaaagccaataatcaagctatcgcccagtcgtcgggacgttacgtactgttactcaatcccgatacggttgtgggagaatcggtactcgacgaagcctgccattttctcgacgaacacgatgatgcgggagcactgggcgtgaaaatgatcgacggagacggaaagttcctgcccgagtcgaaacgaggatttccttcaccgtgggtctcgttctgtaaaattttcggcttgtccaaactgttcccatacagtcaccgtttcggacgttatcatttgcggtttctcgacgagaacagtacacaccgagtcgacgtactctctggggcattcatgttgttgaggcgttccacactcgatcggtgcggtctgctcgacgaaaactttttcatgtacggggaagatatagacctctcgtaccgcatgacgcttaccggagaaaaaaattactacctgcctctgcgtattcttcattacaagggagagagcaccaaaaccgagtcattgcgttatgtgcgtatcttctatcaagcgatgtttatcttcctgcgcaaacactatcctcactataaactgtttgccctgttgtctatcaaaacagccatctatatgagagccacgactgctgccgtgaggcgtttcctttttcccaaaaaagaaaaacgatgcgatgtcaacgggaaatggtatatatggagccgtgaagctgacccgataaaaaacatactggacaaatacggtatcaccccgacccttgtaactcccgacggtcgcgatatagctccgcatcttttccgttcagaaaatatacgccatgtcgtgttcgaccgaaaaacactttcttacggacgcatcatcgaacaaatggaaagatggagcgttcccggtaaagtatgcttttacatctattcgcccgatagcggaaaaatcgtttcggcgcattcgttattgacttag

SEQ ID NO: 3028 - DNA, 1917 bp, Bacteroides sp.
atggagcaaagtattcacgaaatattgaaacgttattggggatatgactctttcagacccttgcaggaagatatcatacaatcggtcttaaaaggaatagatacgcttgcgttaatgccgaccggtggcggaaaatcgattacttatcaggttccggggttatacatggacggtatatgtatcgtggtaacgcctcttatcgcgttgatgaaagaccaagtagacacgttgcgggccctcgacataaaagcatcgtatatacactcgggaatgagccgacgggagatgctcactactctcgacaactgcatattcgggaaatacaagttcctctatgtttctcccgaacggctatcgacccaacttttccaagaaaaactcaaagatttaccggtttcactacttgttgtagacgaggcccattgtatttcgcagtggggatatgatttccgccccgattatttaaaaatagcggaattgcgacagacaattccccaaatacccgtacttgccgtaacagcaaccgcaactcccgaagttgcaaaagatattcagactaagttgctttttaaggctgaaaatgttttccgaaaaagcttccgtcggccgaatcttcgttatgttgtccgttacaatgaagacaaactgcaacaactcatctatatattatcccgcgtcccgggaagcgccatcgtgtatgtccgcagcagaaaacgcacaaaagaggttgcagaggtcttatatcgtgcaggaatatccgcacaatattatcatgcgggtatcgatcccgaagataaagagcgcagacaacaagagtggaaagaagggcattcccgggttatggttgcaacaaatgcttttggtatgggaatagacaagcccgatgtgcgtctggtcgtacatctcgatatacccagttctcccgaagagtattatcaagaagccggacgggctggacgggacggaaacagttcttatgccgtcctgctctactccccgaccgataaatccaagctgcataaaagggtaacagacatgttccccgaaaaagattttatagtccgtatatacgaagccatgtgcaactatttgcaagtagccgagggatttggaataaactcagtacatgatttcgatttgaatcttttttgtaagacattcaaattcccgatactgcccgcttaccacgcgttgaaaatattggaacagtcgggatatatagaatacatagaagaagccgattcgcagtcccgtgtcatggtaaccgtacatagagacgaattgtataaactaaaaaccgacgaccccgataccgatacggtattgcaatgcttgttacgctcttatacaggattattcgccgattatacatttatcaaagagtcgattatcgaacggcgtacagggttgtctcccgaaacaatatacgagagtctcatctatttggggaaattacacattatccattatgttcctcgaaaaagaatgcccttcattctttttacctgttcccgtacaagattgaaagatcttgtaataccccggtcggcatacgaagaacgaaaagagcgttttgtatatcggatagaacgtatcctgcaatatactttatgcgaaaatatttgtagggaaaaattgttactcgactatttcggtgaaaaaacgaccgataattgtggctgttgcgatgtgtgtcaaaataagaaaaacgcgactttatcgccagttgtattcgaccaaattacctccgccctgcaagacttattgagaaatgaaccgctcaaactgaacgaattggtcgaacgattgcactatccgcaagaacaaattgtagaaacgattcgttatcttgtcgacgaacgcttcctgcgacaagataaccaaaaatattttttgaataacaacaaaaaacgataa

SEQ ID NO: 3029 - DNA, 1212 bp, Bacteroides sp.
ggattgagactgttgcatcatgccgatagcaatacgcgaatggtcgctataaatctgttgtatgatgtgggggctcgggacgagtctccggattgtacgggttttgcgcatctttttgagcatcttatgtttggcgggtcgcttcatatccccgatttcgatacggcgttgcaaaaggccggaggtgaaaacaatgcatggacgagtaatgacattacaaattattatacgatagttccccggcaaaatgtagagactgccttttggttggaatccgaccgaatgttggggttggatttttcccaacatagccttgatgtgcaaaaggccgttgttatggaagagttcaagcaacggacattgaatcaaccttatggggatattcctgccattatacgggaattggcttatcgggagcatccttaccgctggccggtgataggccgggatatatctcatatagagaaagctacgctcgaagatgtaagatcttttttttataaccattatgctcccaataatgcaattttggcagtagtcggcgatatttcttttgaagaggctttgcgcttatccgaaaagtggttttctcctattgagaaaagaaatatagcaccacgttgtatcttgcctgagccggagcaggaagcgcctcgctataaagaggttgtcagagacatcccttctgatgccatcgtgaaagcttatcatatgggccgacgatgcgatgccgattatcagacctgtgatttgatgtcggacatactgtcaaacggtcgttcttcccgcttatttcgccgtttggttatggaaaagtcgctttttaccagtatagatgcaagcattacgggtgatattgacgcgggtctttttttgataaatggccgattgaatcaaggtgtctcgttacaacaggccgacgaggccatagaggaggagttggggcgactttgcagggaatcagcctcggaacaggaaatcagtaaaatggtgcataagttcgagacgggatatcttttttcaaatttgagttatgtcgacaaggctgcgaatttatcttattttgagttgatagatgctgccgaatcgatagacagggaagtcgagaaatattatcgtatcacgccggaatcgttgcaaaagacggcacaagcggtatttagagccaataatatgtctacgttgtattacaaagctcagaatagttgttga

SEQ ID NO: 3030 - DNA, 2409 bp, Bacteroides sp.
atgagcgaaacgaaggacaacaagcaacgaaacgcagaaattcacccggaagaaggtggatcggccgacagcggacaacaaccggtttccatagagaaaaccggcgaatctatccgtgaaaaaaatccggctccgataggaactgatccaataagccatcagaccgaggagcaagaagacatcatgattgaaaaagaatttcagggcttgcttgttgaatacctcaactcgaatcatcggaaaaaagtcgatatcatagaacgtgctttccgtttcgccaaagaagcccatcacgggattcggcggcgttcgggagagccgtatatcatgcaccccattgccgtagcaagaatcgtctgcgaagaaatggggttgggttcgacctccatctgttcggccctattgcacgacgtagtagaagatacggaatatacggtcgaagacatcgaaaaccttttcggccgaaaaatcgccatgatcgtctcggggctgaccaaaatatccggcggtattttcggagaccaagcctctgcccaagccgagaatttcaggaaattactgcttaccatgtcggaagacattcgcgtcattctcgtaaaaatggccgaccgcctgcacaacatgcgcacattgggttctatgttacccagcaagcaatacaagatcgccggagaaacactctacatctatgcgccgctggctcaccgattagggctttttgccattaagacagaactcgaagacctgagcttcaaatacgaacaccccgaggcatacgctgaaatacaacacaacatcgcatcgagcgaagcctaccgacagaaagtatttcacgacttcgccgcgccgatcaccgagaagttgcacgaaatgggtgtccaattcgaaatgaaagcccgcgtaaaatcgatttattcgatatggaataaaatgcagagtaaaaatattccattcgaagaggtgtatgacttatatgcggtgcgtatcatattcgaccccaagcaggaggaaaacgaaaagaccgaatgctttaacatttactcggtgatcaccgatatttataaagttcaccccgaacgcacccgcgactgggtaagccaccccaaagccaatggttaccgggctttgcacgtaaccgtcatgggccccgacggaaactggacggaggtacagatacgcagccgaaaaatggacgaaatcgccgaacggggatttgcggctcattggaaatacaaagtaggtggtgccgacgaagaatcggaactggatatttggctgaaaacaatcaaagaaatactcgaaaatcccgaacccaacgctctcgattttctcgatacgatcaaactcaatctttttgcctcggaaatattcgtatttaccccgaaaggcgaattgaaaaccctgcccaaagacgccacagccctcgatttcgcattcattctccactccgacctcggctaccactgcatcgcagcaaaagtaaatcacaagctggtaccgttgagccaaaaactacaaagcggcgatcaggtcgaagtccttacttcgaaatcgcaaacgcccaaagaagaatggatcaatttcgtaaccacagccaaagccaaaacccagttacaagcagccctgcgtaaagagcggaaaatcatcgcggccaaaggagaggaaatctacaacaaatttatttcgagcaaccatcttatcaccaacgatctgagtatactcgacagaatactcaactacttcgacatagacaagaaagaggaacttttctatcaactgggtaaaaacgatatcacgctcgacgaaggagtaaaaaaattattcagaggaaaaaacaaaaacgtattcatgcgttatttgcgaaatcctttcagcagcaacaacaagtcgacccacaaacacgccgagaaaagaatcccaatcgataaaaacatcgttattcccgagaaaatagatcgtaaagcgacctatatactcaaaagcaacgaaaccgaacgcaactatatcatcgccacatgttgcaaaccgattccgggagacgatgttctgggatacgtcaatgaaaaaggcgaggtcatcgtacacaaacaatcctgcccaatagccatgaaactgaaaagcagtttcggcccccggctgatttcggtaaaatgggataaacacctgagcgaatcttttccggtagaaatcgaaatagacggtatagacaacatcggggtactcaaccgcatcacacatatcatttccgatgacatggccgtgaatatccggaacctgacaatatctaccaatgaaggcttatttcacggagaagtgggcgtaatggtacacgatgcccgcgacatagagaaactgtgcaaccgactgaaaaaaatagaagacgtaaaatcggcagcccgaaagaattaa

SEQ ID NO: 3031 - DNA, 1311 bp, Bacteroides sp.
ttgttgatagaaaaatgttttaccgataaagatatgaagttaatatttagaacctctcttttgctgttttgtatcgcattgtatggcgtgccttccgaggcacaagattcgatcggggaaaaaggaccggggccggttattcttatttcacgggataaaaacggtcaggacgaaatcgtcaatgtctttaaagagactcagcgtcagcactttcatgatccgggtattcctcgttttttgttggccgacaggaagcgaaagtgggctttgggtgtaggtggatatgtgcaggctgtggtcgaatatgattttggcggcatttcggacgatatagatttttttccagcatttatatccggggggaaacctcgtagccagtttcagatggatataacgacctcgacgctctttctgaaattggtgggccgggtcggtaaatgggggaatattattgtctataccgccggaaattggaggggcgatggaaatacatttgagttgcaaaatgcttatgtgcagtttcttggtattacgtttgggtatgatacgggaacttttatggatttggcggccggccctccgaccatcgattttgcaggcccttgcggtatgacatcctatcggaccactcttgtacgctatgaacggactttgggaaagggcttttctgtgggtattgcattggaaatgcccggtatcgagggggcgaccgatcgttatacgtcggtagatcatcaactcgtcccgagtgttcccgcttatgtacagtacggttggaataaggggaggagtcatatccggttgagtggaatttacaggaatatagcgtataccgacttggctaatgataaaagcaatagccagacgggatggggtgtgcaggctacctctgttgttgcgattggaaagccctttcaaatatatctccaatatgcttacgggaaaggcatagggagcttgataaacgatataagcaatctgagtgtggatatagtccccgatgtcgataacgtaggtaaaatgcaactccttcctatgtcgggttggtacgccggggtacaatataatttcacgccgaagattttcatgtcggctacatatagccagtcgatgcttcatgccggaaattattatcggatagtaaatcccgaacaatacaaactcggacaatatctcgttaccaatcttttctggaatgttattcccgatttacagttgggaatggaatatctgcatggttggcggaaggatttcgataaaaacggagatcaggcaaaccggataaatttgtctgcgaaattcagtttctaa

SEQ ID NO: 3032 - DNA, 1119 bp, Bacteroides sp.
atgacatttcaacaattgaatatttcccagcctgtattgaaggcattggaagagaaacagtttagtaccccaacatcgattcaacaacatgctatacccgtagctctgggcggtcgggatattttgggacttgcccagacgggaaccggaaaaacagcagcttttgcaatacccgtgatagaacatctgtatagaaaatcacaagcagaaaaaacgcggagcatcagagctttggttttgactcccacgcgagaacttgcgatccagatagaagaggcgtttgcagcttatggaaaatatacccgacttaaatgcgtggtaatttatggcggagtgagacagaaccgtcaggtcgagcagcttcgtcgcggagccgatatactgattgcgactcccgggcggttattggacttgataagccagaaaatcgtggatttgggaagtgtaacacatttcgtccttgatgaggccgaccgtatgctcgatatgggctttgtgcacgatatcaaacgacttttgccgttattgccgcaaaagagacagaatctgttgttttcggctacgatgccaaaagagattgccgttatttcggaaacgatacttcatcagccggtaaaggtggaagccgccccggtttcatcggtggtcgatacgatcgaacaacgtctctattgggtggaaaaaaacgaaaaaatagcacttctggtcgatgttttgaatacacatatcgataagacgatactggttttttcccgaaccaagcacggagccgataaaattgcgcggattcttaataaaagagatatagagtgtatggctattcacgggaataaatcacaaaatgccagacaattggctttaagttgttttaagtcgggaaaaataagagttatcgttgcgacagacattgcagcccggggaatcgatgtgcagaatctcggggttgttgtaaattacgacatgcccgatgtggcagaaacgtatgtgcatcgcatcggtcgtacgggacgtgccggtaaccgggggattgctctctctttttgctcgaaagacgagagggaagtggtgaggaatatccgaaaattgacgaccggcagactcgatgtcgtatcggtataa

SEQ ID NO: 3033 - DNA, 1386 bp, Bacteroides sp.
aaaaacaatatagaaatgaccgaattaatcagaaaaaaactcaatgacagtcccatagcccgttggacggctatgtttatcgtatcatttaccatgatgtgcggctattttatcaccgatgtgatggcgtcgctcgaagttatgtgtacaacgcccgttgccgacggcggtttgggttggagcagctcggagtacggcttcttctcgggcgcatacggttatatcaatgttttcttgctgatgcttttcttcggaggtattattctcgataagtgcggaattcgttttacgggagtcatgagttcatctcttatgttgggtggagctttgctcaaatggtatgctttggcaaccgatttcggcgatgctacatttatgggctatcaccttcaagtcgttttggccagtttggggtttgccgttttcggtatgggcgccgaaattacgggaattacagtatcaaaggtcatcatcaagtggtttaccggccatgaagttgcgttggctatggggttgcaggtagcgatggcccgtatcggtacggctgtggcattggcgtgtagcttgcctatggcgagagcaatgcatagtgtttcttatccggtactattcggtgcgctttgcctgtgtgtaggtttggtggcatacttggtatattgtgtcatggataagaaactcgaccagtctgtcgaagcggtcagcgaggaaaaggaagaaggtttccagctgaaagatctgaaactgatttttaccaacaaaggcttttggctgattaccttgttgtgcctgatgttctatgccggggtgttcccgttcttgaaattcgccacgaagctgatgattgccaaatatcatgtagaacccgaaatggcaggacttattcctgccatgttgccgttcggtacgattttgttgactccggttttcggaactctttatgaccgcattggtaaaggagctacgcttatgcttattggatcggtcatgttgacgatcgttcatcttttatttgcattgcctattttgcctacgtggtggtttgctatcgtaataatggttgttttaggtattgccttttctttggtgccttcggctttgtggcccagtgtacctaagattattcctatgaaacagctcggatcggcttatgcgacgatattctatattcagaatataggcctctctatggtaccggtacttatcggctgggtcattgagacctattcgacacatgtcgatggagcaggtgttgtaacgtatgattatacgatacctatgcttattttcgccacctttgggattgtggctatatttatttctctctggctgaaaagagaagatgcccgttcgcattatggtcttgaagacccgaatatgaaaaagtaa

SEQ ID NO: 3034 - DNA, 1440 bp, Bacteroides sp.
atgaataccaaaatttcccttcctgaattgatcgaccagttgagtcggaaaagcaactgtaccaaaaaagaagcggaacagtttctgaaagagtttttttcattggcagccgacacagtcgtacaaggagaaaatcttaaaatcaacggtttgggccagtttcggctggtttgggtagaaccgcgtgtcagtgtcaatgtacgtaccggcgaaccgatggaaattcccgggcattacaagttatcgttcgctcctgataaaacgatgagagaggctgtcaatgctccgttttcttgttttgtacccgaagttttgcccgatgatgccgaaatcgttcaaggcgaaaacgccacattgcctgatgacgtcgatgaagatttttccgataaaatcgtagaagaagattatgacgatgccggcgatatgaaatgtgaagacggggtatcggagtgtcgaagagaagaaatcgttacggaacaagaaacgacagatgtgaaggaatttcctggttctgttgaagcggagttgacggaagaatcgggtaaagaagaatctgctcaggtcgtgaacacctccgggaacgtgcaggaaaaagctgaatacgaagaacctgtaaaaaatctttcggaagaagaactcaatgctttggccgattttgtactggaaaaaatcgtggccgataacaccacacaagaaacttctgggaaagaaaatgctcgggaggttgtctccaagactgtaacggcgacagaggatatttgtacggggcatcgggaaaatgagataaaagaagagagagatctttccgatgacaatgtcgcagaagatgccatttctgatagcgggagttccgaagaagattttggggaagaagaacgcatttcattgtgggataaaatgcaacgacgtccgctccttaccggtatgtgctctgttttgttgcttttattggtgattgccggcggtacggtatggaatttaaatcgtcaaggcatcacactgggagatgcgtggaattactacttcccatcggagcagcaggccgtagaaactctttctgtgggaaaaagtgcccttttgcaaaccgatggagaaccgcttgaagaagagaacaatcttcggtctacggttgttacagaaaaagaaacgatgtcgggaggagggcaggtcgaccttcgatcattgccaccgcttgcctcacatcgcttgggtgttggcgacaggctaaccttattggctctcgaatattatggcagcaaagatttttgggtgtatatctatgaagagaacaaggagcgtatgcccaatcccaatcgtctctctgtcggcctcgaagtgaaaattcccgatccccgtaaatatggtatcgatgcggaagatcagcaatctttggcgagggcgaaaagctttgccgaaaggctgaaagaaaaattcgagtga

SEQ ID NO: 3035 - DNA, 2532 bp, Bacteroides sp.
atgtatatctttgttgagttctcttttatgtcttatatcatgaaatgtcaccgtgccgcttcaggttcaatgccgaagataagttcctttataggaatttttgtcttgatgcagatttttttcggtatatcgtctgcccgggcgcaagaaggattgaagttgtggtatgataaacccgcgggtgaatgggttgaggcgttgccggtagggaacggacgcatcggggcgatggttttcggcggagtaagcagtgagttgatccggctgaatgagtcctcgctttggtcgggttgtccggtacaggatagcctcaacatcgatgccccttgttacttgcctttgattcgtaaagctcttttcgagggcgatttttctacggctgcgcaaggttgtcggttcatgcagggaccttatagtgccagttatcttccgctgggagatttgcatatctcatatatgatgccccgttcggctcccaccgattattatagggcgttgaatctctcggaagcatcggccgttactcgttttacggtggctggtattacctacgaacgggaggtgtttgcttcgtcttctgatgatgttttggcagtgcgtctcactgcttcgagaaaaaattccctttctttgtatatcactctttcttctccgttgcattatgagatggaagccccggctttcgatgaactgacgatgcggggtgttgctccgatacgggtcgatcccgattattatgtagtcgatggtcggagtccgattgtttatgaggagaacgggcataccggcatgagattccgtacctgtctgaaagttgtagccaaaggcggtgtcgtatcgtccgatacgtgcgggatacatgtcgatcaggcatcggaagtggtggtgttgctttcggcagctaccagctttaacggttttgacaaatatcccgataccgaaggtgccgatgaaaaaagtcttgccgaaaacatgttgcataaggcatcggcctatacctacaagaatttgaagaaacgccatgtttccgattttcgaaaatatttcgatcgtttctccgtttctttggggctgacagccgattctttgaaaaagattcctaccgaccggcggctcattgcttatgcccggggacattccgatcccgagttggaagcgctttatttccagtacggtcgttatttacttatttcttcttctcgtataggtggtcgtccggctaatttacaaggtatttggaatccttatatacaagctccgtggagctccaattatacgataaatgtcaataccgagatgaattattggccggccgaggtaacatctcttccggagatgcatgaaccacttctcgactggatttccggcctgtctcgtaccggtatggttacagccagacagttttatggctgtcgaggttggatggcacatcagaattccgatatttggtgcatgagcaatcctgtggggaatggtgtcggagacccgacgtgggccaattggtacatgggcgggaattggctgtgcaggcatctttatgaacattatgcctatacacgggataagagttttttacaggaagcctatccgattatgaaaggtgctgcccgtttttgtttggattggttggtggagaaggacggttatttactgacggctccgtctacttctcctgaaaataattatcgtgtcgacggaaagatcggttccgttacgatgggggcaacgatggatatgtctatcatttgggatctgtttacccaccttatcgaggcttcggccgttttgggtatcgacgcgtcgtttcgggatacgcttgttacggcacgggaacagctttatccgttgcgtataggaagccggggagagttgttggagtggtatgacgagtacgaagaggtagatccgcatcatcgtcatgtctcgcagctttacgggctgtatcccggtcgtcagatttctcctctttatacgcctcggtatgccgaggcctgccgccgtacactcgaaatgcggggcgacgggggtactgggtggagtaaggcatggaagataaatttttgggcgcgtttgctcgatggagaccatgcttataagatgatacgcgatattatgaaggctgtcggtcccgggacttcaaataagggaggtggtacttatcctaatcttttcgatgcccacccaccctttcagatcgacggaaatttcggtgctactgccggtttggcggagatgttgttacaaagccatttgggagaaattcatttgttgccggccttacccgcagcctggtcgcggggagaggtctcgggattgaaggctcgcggaggctttgatgtctctttttcttggcgggacggacgtcttgtaaaaggagagattctctccgtggccggagaatcttgcaccgtgcgatcgaaacagcctctttttatcaagggagcgaaggtctcggcccgagaaaagaatgggtattttatatatacgtttgctacgcgggagggtgtccgatataagtttttgacagaataa

SEQ ID NO: 3036 - DNA, 1905 bp, Bacteroides sp.
atgagcgatattatccatcttttacccgattccgttgctaatcagattgccgctggtgaagtcatacaacgtccggcatctgttgtgaaggaattggtcgaaaatgctatcgatgccggagcgaccgagatacaaatctttataaaagatgccggacgtacattgatacaggtggtcgataacggtaaaggtatgtcagagaccgatgcccgattatctttcgagcgacatgctacatccaagataagttcggcacaagacttgtattctttgcgtacgatgggatttcggggcgaagctctcgcttctattgctgccattgctcaagtggagttacgaacccgccgtgccgaagatgagatagggacatcgattctcatatcgggttcgaaagtcgaatcacaagaatatgtctcgtgtcccgccggtgcgaatttcatgataaagaatatttttttcaatgtcccggctcgaaggaaatttctgaaatcgaatcaagtggaattcggatttattatgtccgaatttgaacgcatggcactggttaatacggatatagctttcaagctcgtccacaatgatgtagaattatataatctcccggcgtctaatttcagacaacgtattgtctccttattcggtaagaatttgaaccagcaccttctctctgttgatgttcagacttctttggtttctattactggatatatcggacaccccgactcggcccgcaaacgcaatgcttggcaatacttttttgtcaatggtcgatatatgcggcatccgtatttttataaggctgtcatctccaattacgaacaattgttgcctgccggcgagatgcctcactattttctgcatatacaagtagacccatctaccatagatgtgaatattcatccgacaaaaacagaaataaaatttgagaatgaacaacctatatggcaaattttatcggctgccgtgagagaaacattgggaaaatccaatgctgtcccgacaatcgacttcgataccgaaggtgcacccgaaatacctatattgcatcacggtcagcaggttgagccacctcgggtatcatattctcccgattacaatccgtttgcgtcgttttctacaaaaccctcgaatcattcgcataaagtcgattacgattggactcagctttataaagattttcaatcgaataaagatatgcctatgaccccagaagaggggtccggagagataaaaataccttctaagataaattgcctgacttctgtcgaggatatgaccaaagtatcatcggaagcgataccgctttccattccgatgcaggaaacttcccgttcgatagatacgggtattgaacatttgcagataaaaggtcgctatatattgacgtcggtaaaatcgggactgatgattatcgaccagcatcgggcgcatgtacgcatcttatttgatcgatatatgtctcatatacaggataaaaaaggcgtttcccagcgtcttctttttcctgaaatgatacaattgtctccggcacaaggagcagaattgctatcggttcaagaagattttgaagcattgggattcgatatttccgatatgggaggaggggcttacgccgtcaatgcagttccggcaggtatcgacgggcttgatgtgtcgacgttgatcgataaaatgctcgaaacagcgacgcaaagaggcggcgatgtaagtgtcgacgttcatgaagccatttcgttggcattggccgagtcggctgcaattccgtatggacagattttatctccgctggaaatggagaaattgatcagtgatcttttttctttaacagcccccaattatactcccgacgggaaaaccgtcgtatcggtgataggggatgatgaattacaaaaaagattccgatag

SEQ ID NO: 3037 - DNA, 1368 bp, Bacteroides sp.
atgaacgataaagaacgaatcgatacgcaacgtctctttttcgggaaacgaaaacccctctccctcaaatacaggttacaatcgctcaaacggttgcaaaaaaccatacggcaatacgagtccgacatagaaaaagcccttgaaaacgatttacacaaatctgtatacgaaagctatacgaccgaaatcggatttgttttgagtgaattacgacgcacaatcaagcatttgaaacaatgggccgcacctcgacgcacccgcatgccgctttttcttttcggctcgacaagccgcatcgaattccaagcatacggaaacgtattgattctcgcaccctggaattacccgttccaattagtcttcaccccccttataggtgctgttgctgccggaaactgtgtaaccgtaaaatgttctccttatgctatccgcacaagtgaaatatgtcggaaaatcattgacgaagcctttgacagaaggcacgtcttatggatcgataccgataataaaggaaccgacagattgctcgaaatgaaatgggactatattttttatacaggagggcctgtctacggacgtaaagtggccgaggcggcagcccgccatctgaccccgattacactcgaattgggaggaaaaagcccgtgcatcgtacatcacgatgcacatctggcatctgccgcaagacgtatcgtttggggaaaattcatgaattgcggacaaacctgcgtggctcccgattacctgctcgtacaccgcgatattgccgatgagctcatagactctttacggcaagaaattgtgcgacaatacgggaaaaatccacaagaaaatagtgattatcctcgtatcatcaatgaaaaaagattttacgaacttatactgctcacaaaacaaggacatatcgaacacggcggaatatatgatgcggacgacttatacatcgcaccgacactcatttcgcacataactcccgatatgcgtatcatgcacgaagaaatcttcggtcctatacttcccatcttgcaatatacaaccctcgatgaagccatcgattttatcaacagccgggaaaaaccgctcgcattatactatttcggtaacaaacggaaagagatgaaaaaagtattgaaccaaacttcatcgggcggttcctgcatcaacgatgtcgtatctcatgtcgctaatccgtatctcccgttcggtggtgtgggaaacagcggaataggtcattaccacggacgggaaagtttttatactttcagccatacccgctcggtgttacaaaacaatacaaaatggaatcccggcatcaagtttgcacctttcgccgggaaactgtctcttataaaacgactactgcgataa

SEQ ID NO: 3038 - DNA, 1332 bp, Bacteroides sp.
atggaaaaagaacaaaagccccgtcgtccccgtatcggagagacaagagggagtgccaactatgaaggcagcagtgaaaaatacgaaaaagtaaattattctcgtcgaaacgattccgattacaactttaacaatcgacgcccttacaacaacgaaaatcgcaccaacaccggctattataaccgtcggaacgatacttatcaaggcaataattataaccgtaattataatttcaataacgatcgctcgggagaagataatttcaaccgttacggagattacggacacaatcgcaacaattacggcgagcgtcagaatggaaactataaccgtgctgataactaccaaagcggatataaccgaaacaactacaacaatcgccgcccgttccgttccaacaacgagacaaacgaagagaccaactacaatacaataggagaaaacaggccttatcgtcaagaagggaaccgatccggattcaataacagattcggcggctataacaagccctacggaaaccaacaacgccggccctacgggaacgggaataatcgtcagcaacgtccggccatgcctcggagaatcgtttacgacgagagtatgatagaccccaatgaaccgatacgcctcaacaaatttctggctaactcaggattgtgttcacgtcgagaagccgatgagtttatccaaaacggagaaatcaaagtcaacggtgaagtcatcacagaattgggcaccaaaataacccgcaacgatgtcgttactcacaacgataaagtcgtattgcccgaacataaaatttatgttctgctcaacaagccgaaagactgcgtaacgacgtcggacgacccgcaaggccgtcttacggtcatggacatcgtaaaaaatgcatgttccgaacggatttatcccgtcggacgcctcgaccgtaataccaccggagtgctcttgcttaccaacgacggcgatttggcctcgaaactgacgcacccgaaattcgtcaagaaaaagatttaccacgtatggctcgataaagatgtagccgaagaagatatgcaacgcattgccgacggtatagaactcgaagacggtcccatacacgccgatgcaatcagttatgcgaccgagatcgacaaaaaccaagtaggcatagaaatacactcgggccgcaaccgggtggtacgccgcatattcgaatcattgggctatcgggtagtaaagctcgaccgcgtatattttgccggtcttaccaagaaaaatctgccgcgcggtcgttggcgtcatctgacccaacaagaggtaaatttcttgaaaatgggatcattcgaataa

SEQ ID NO: 3039 - DNA, 1812 bp, Bacteroides sp.
atggacaactatatcgtctcggctcgtaagtatcgccccacaaccttctgctctgtcgtcgggcaaaaagctttggtacagacgctcaaagcggcggtcgttacccgcaaactggcgcacgcctatcttttttgcggaacccggggagtgggaaaaaccacttgcgcccgcatttttgcaaagaccatcaactgcgaacaccctacacccgacggggaggcttgtaacgaatgtgagtcgtgccgtgctttcaatgagcagcgctcgtacaacatcatcgagctcgatgccgcatcgaacaactcggtcgacgaaatacgcagccttatcgataaagtgcgcgttccgccgcaactcggacgctacaaggtatttattatcgatgaggtacacatgttgtcgacggcagcgttcaatgcgtttctgaaaaccctcgaagaaccgcccaatcatgccattttcatattggcaacgaccgagaaacacaaattgttgccgacgattctgtctcgttgccagatttacgatttccagcgtatcaccattgaagatatagtcgaacacctgcgttatgtcgcttcgcaggaaggttttaccgtcgacgacgatgccttgaatgtcatcgcccgtaaggccgatggcggtatgcgcgacgcattgtctattttcgatcaggtcgccgcctcctcgggtggaaatatcacgtaccagacgacgatagaaaacctcaatattctcgattacgactattatttcaggctcaccgatgcactgttggacggtaatatcccggaggccttgctcgttttcgactcggtattgcgggctggtttcggagcgcaacttttcgtcaacggactgagcagccatttcagggatctcatggtaagtaaagatgcggcgacgctcccgttgctcgacgtcgggacggctgtcgccgaacaatatgcccgacaagccaaacgttgcgacaaggctttcctctacaaggcgatggatttgagcaaccgctgcgacctcgactaccgtatcagcaacaacaaacgtttgctcgtggaattgatgcttataaagatatgcagtctcggaatgccgcaagaaataggacggtcgtccgaagcaagaatactttcgaccccgtcaactcctgccgcaaaccctcgtccagcggtgtctccgaccaccgctcaaacaaataagtcggttgtggaggccgtggcacaatcgccatcggcagcatctgaaccccagcaggaatacgggcaaccccggacggcaggtgaagaagcagctccggcagcctctcgcctccaaattccgagaccgcaagtcgctactccgcaggcaaaagttccgactcgtaaaattcctcgtatttcactcaaacacggtgtagagccggatccttcggaaacgccggtggcaacagtcgaaacgactgtcgaaatgaacgagccttttgctctcgatgccctgcatgaggcatggctgcgttttaccaaaaagattcctaccgaaacggtattggtacagacaatgtatttgtgtatgcctcaaatgctcgacgccacaacattcgaggtcgtggtcgataacagagcccaaatggataagctcaatggccggggggccgacctgatggctttcctccgcacggaattgcgcaatacacatcttgaaatgcggattcgtgaacgtgaacgcgaagaacggcaaaaggcattcagccccggtgaacgatttgtcatgctggccgaaaaaaatcccgaattgaacagactgaaagacattttcggtctggaactctcttaa

SEQ ID NO: 3040 - DNA, 1452 bp, Bacteroides sp.
atgacagacgctttctctcgggaaagtacagaacccggcttatcgtcctgctgtttttttaataaaacttccggcatggcagcgacaaaacaaaaaaaatggcgcattatttttcgtcggacatatcggtttatcatatatgatatgtggcgtattacgggaaatgaagtttccggtagccgccatcggctcatcaatctgatgaagaccatttatctctcgatacaacgttttatcgccgatgatttgcaggcacgcgccgccgcactcacgttcaatacgttgctggccattgttccggcgctggcattggtctttgccgtagcaaaaggatttggtttccagaccatcgtacaaagtcaattgttcgactacttccccgctcagcgagaggctttggagcaggccatgacttttgtcgattcttatttagcgcaaaccaaagacggcatttttgtgggagtgggtatccttttcctcatgtggtcggtcgtgagtctgctgaatagcgtcgagacgacattcaacgatatatggcaggtgtcaaaacagcgatcgatatatcgtaaaattgtcgattatatcgctattatggtgttgttgcccattttgatgatcgttgccggcggattgtcgattttcgttacatcgggtatcgataccaaaccgatgttggcttttttgagtcctgtgttgcgttttgtattggcgataagtccttatattttgacttgtatcgtttttacggctttatatattttggttcccaatacgagggtcaagttttggaatgctctggtatcgggggtaatatgcggcttgtcgttccagttgttgcagtttgtctatatcagcggtcaggtatgggtttctcgttacaatgccatatacggcagttttgctttcctgcttttgtttctgttatggatgtggatttcgtggctcatttgccttttcggggcggttctttcgtattcttcccaaaacgtcgaaaaattcaatttcgataaagacataaaaaatatcagccgtagatataaagattttgtcgtactggtggttgtttcggtcatcgtacagcgttttgtacggggagaggctccgctcacccgacatcagatagcgtcgtcttatcgcataccagtacgccttacgggacaggtcttgcaacagttgttggaggccaaaatcatacgaggtacacctacctccgacgaacgtgtgtgggcatatatgccggcaatcgatgtgtcgagattaagtgtgggcatgcttttaaggcgtctcgaccgtaacgggtcggaaaatttcaagatcgaccgccgtctttatcataagcagtggcgggctatgctcgatactcgggaggcctcgtatctcaaaggcgatacgatgctggtaaaagatttggatttcaattctttcatgaaagatataaaaattgaagagtag

SEQ ID NO: 3041 - DNA, 1131 bp, Bacteroides sp.
atgaaaatcaaacattctttccttttgtggggacttgtatttcttctcttcgtttcttgcggagaaaaacaaaattatctctcaggccagattgaaggtttggaaccgggtgattgcattattttggggttgatcgacccgattaccgatgaaatttacatatccgattcgaccatcgtagaaaagaaaaatcatttcgacttatataccaaagcgacagaccaatgggcatatttagctcactgtcctaaaaacgagaaaataaaaatcgaacatcaccgaggaaacagattccgtctctttcttgaaggatacgcatctctccacctttccggatctaccgacaatttccactacctaaaaattaccggcggtctatatgaaacgcccgatttgagaccggcatttaatttgatggacagcgctctactcatacaacaagacggtatcggccggtccccgtccgacccattacgacggacattgatcaaaaaatcgaaccgtatgttgatgaccgtagactccatggaacaacaatttgccgatacacatcccgattttgcatactcggcagccattatgcgctatgtcaatgaaaaagaactagaaaaacgtttccgacaattaacgccacgagtacagaaaagtgtgccgggcatagcggtcagcaatcatttgcaaatatttcgatcgacacaaccgggtggacttgctcccgattttacacttttatcactaaccggagattcgatacgactatcggactacaaaggaaaacacgtatttttggaattttgggggtcttggtgcggaccttgccgcatgatgtctcctaagctcatagcattcaaccataccctaccgtccgacagttctatcatcatgataggcatagcctgtaacgaagcgagtaaaaagaattggaaaaagaccgttgaagaagataatctcaactggattcaagttctagaagaaaacaatcaagggaaattatccgtgagccgccaatatgcaatcgacggctatcccacatcattgcttatcgatccaagagggaaaatcattttacggggccaccccgaacacatattagggaaagcaagtgctcttctgggtctatcctctaaataa

SEQ ID NO: 3042 - DNA, 1605 bp, Bacteroides sp.
atgaaaaagacgattttgctattactgcctctcctgctcacaacagcatgcagccacacaaaaatcatagagcgaccagaaattgcactcaacagttcgacaaactatctgtctctcgaacgtgtcgtatgtactcccgaggcaacccgtctcgacctgactgtatgttgtatttccggaaaaggcttttcgatagaaaaagaagcctatctgcaaagccgggaaagcggactgaaatatgtacttacaggtgcagaaggcatcgaaccgggcaagaaaataaaaaccgactctaccgggctggtcgatatttcattactattcgaaccgattcctaccgatgaaaaacaaatcgatttcatcgaaagcgaagactggcaactcttcggtatcgacctgagcaaaaagaaaaagcctgtacaaatagaatgcctcatagaagggactgtcataaaccgcccccaaagctcggccattctattgaacacatcagaaaaagtattcgaccgacacaccaagggaaatatagttatccccatacgcaatggaaaattttcttacttgttgcgaaccgatacctgtacgacatacggactttgcttcaacgacgaatgggtaaacggacgcatgttgaataagatttttttcgctgaaccgggaagcatttatctgactatcgaaggagatgattctgtacacatcgaaggagggaaacttaccgaagaatatcaaaatatccagaaatacggacgagatcgcctgcaaccgatttatgacaaacgagactccctctacgacatagagaaactttacacacccgaggtatatgcccttttcaaagaaatggataattgtaatgacccgactcaacgaggtctattgggagaaaagttccaaaacctgcgtgtagaaggaaaagcatacagccgagaaggtaatgctttacaaaaagaggccgaacagacccatgccgaaatcgaaaaatgggaactcgacagaatcgccggccagccctctcttgcaacctactatttgctttttgaaaaaataaaaagggcggtcgtctattcgagacagaccatacccgattccattatcgaaatttatcgaaccctttataaaccgatatatcccgaccatccgtttacccgggacatagaacaatatatcaaagcacaacaaagttttgtcggtgggaaatatatcgacatcgttctacctgacacgactggaacaacataccgtctgtcggacctgatacaaggatgcaaaatagccctcatcgacttctggtcgatacactgcggtccttgccgacgtacctcaaaagccatgattcccgtgtacgaaaaatacaaagataaaggattccgcatcgtcggtatcagccgcgacggtaggcaacaaatgatacgaggaatactccatgacggctacccgtggataaatctcatcgatgaatataacaaaaaccaagtattcaaaagctacggtatcgaaaatactgccggatacacattcttagtcgacggaaacggaacaatcgtcgctagcggagcctcggtcgaagaaatgatctctcttatcgaaaaatactgcaaataa

SEQ ID NO: 3043 - DNA, 1272 bp, Bacteroides sp.
atgatagctctggtcgattgtaataacttttttgcgtcatgcgagcgggttttcaatccctctttgcaaaataagcctgtcgttatactttccaataatgacggttgcatcattgcccgcagtaatgaggccaaggcattgggtatcgctatgggggtaccgttgtatcaggtaagggaactcctcgaacgggaaaatgtcgcagtgttcagcagcaattacaatctttacggggatatgagccgtagggtcatgtgccttctttctgaatttaccccagatcttgttccttactcgatcgatgaggcttttctcgattttaccggagtgtgtaccgaagatcgtttccgggattacggccgacggattgtggagaccgtcgagcggggtaccggcatacccataaccatcggtatcgctccgaccaaaacgctggccaaagtcgccggttatttcggtaaaaaatacccggggtatgggggtgtttgcctcattgatagtgaggcgaaacggatcaaggcgctcgatagttgtcccataggaaaggtttgggggatagggcgtcatcttttggtcaagatggaatattacgggataaagacagccggggattttgtacgtcgtcccgagagttgggtacgccgtaattttaccgttacgggagtacgcacatggaaagagcttcaaggagaaaattgtatcggtgaagacgatttaccgcataagaaaagcatttgtaccagtcgcagtttccccgatcagggagtggctctccatgcgcgactcgaagaggctgttgccaattttacggcctcgtgttgccgtaagctcaggcggcagcatgcctgttgccgggcagttacggtatttgcccatacgagccgtttccgaagagatatgccgcaaagctatatttatcatacccgttatctgccggtaccgaccaataatgtgagcgaacttatctctgttgtcgtgcagttgttgcgggaaaaatatcccgaaggagatacatattattataagaaagccggagtgatggtgtgggatataactcccgatgaggcggtccagacctatcttttcgattcggtcgaccggcagaaacaatcggctcttgccgaggccgtcgatcgtatcaatagaaaaaacggtcgcgatacagtgcgtatagctttgcagggttatgatgtcagttggcatttgaagtgcgagtataaaacatgccaatatacgacccgtctcaatgaaataatacgagtgaagagctga

SEQ ID NO: 3044 - DNA, 2169 bp, Bacteroides sp.
atgaaaaaaatacgtttcctaatctgtgtgctggcttcgattgcaatgtcatttcccgtggctcatgccgatgaaggtatgtggttgctccccctgctgaaacaacaaaatatcgaacagatgaaaggtctcggactcgaaatctgcgccgaggatatttaccaccccgattctgtttcgttgaaagatgccgtcgttattttcggcggaggctgcaccggagaggtcatttctcctcacggtttgattttgaccaatcatcattgcggatacgaccacatacaggctcacagcactgtcgacaatgatttgctcacaaacggcttttgggccaaaagtcgccaagaagagctacctaatccgggacttacggtaacgttcatagacaaaatcgaggaggttaccgattacgtggaagaggaattgaaaaaagataccagtaagatagaaatgaagtatctcaatgcaaaatttctcaactcattggcggaaaaacgcgtgggagaagaatttctgaaaaacaatccgggaacgactgttatcataaaaccgttctacgggggtaaccggtactatatgttcacacaaaaggtatatcccgatgtgcgtatggtgggagccccgccctcttccatcggtaaattcggagccgataccgacaactggaaatggccccgacacacaggcgatttctcgatattccgagtttacgccgacagtctcggcaatccggcgccatacgacaccagcaatgttcccctccgaccgaaaaaatacttcgacctcagtatccggggtgtcagagaaaacgatttcgtcatgctcatgggatttcccggccgtaccaatcacttctacacccccatcgaggtacaagaacggaaaaatatcgaaaatcaaatacgcataaacgtccgagaccttcgccaacggcttttattgaacgccatgctggccgatccgaaagtcaggatacaatatgcgggcaaatatgcctcgtcgaccaacagctacaaaagcagcaaaggcatgaacaccatgatcgaacggcaatcgaccgagtatctgaaagaacggcaaatgaacgaactgctcaactggggttgggataacgatatacaagaataccgggaggccgtagatattatcgcccacgaagtgaaaaagcgagccacactgaaaatccgtatgcaatatctgctcgaagccttatggataggaacggaattcagccgtgtgccgaccaacttcgatgcattgaaaaaaggtctcaacggaaacgattcgacccgcaaagcggcattggaagactttgacaggctctattacaaattctacaacagagactatgcaccggaagtcgatcgccgcatagccaaagctatgctgaaaatgtatgccgacagcattgcacccgaacactatccagcttttttcaaaaccatcgataaaaaacacaagggaaatatcggtaaatatgtagaccatttattcgaaagttctttatttgccgatccgcagaaatatgagaaatggaagaaacgtcctaacatcaaggctctggaaaaagacggcatggtacaatatgcccgttccgtcaaagaagaagcccaacggatcaaccaagcactgtcatctatcgaaaatgagataaccaatgcccagaaacattatatcgcaggacaattgatgttgcatgacgataagcccaactatcccgacgccaattttaccatacggcttacttatgggcaggtaaaatcttattctccatcgaacgccgtaacctacaatttcgaaacaaccctcgacggcgttatggaaaaagaaaatcctacaaactgggaatttgtcgtcaacaaaaaattaaaagatttgtaccaaaggaaggacttcggtttttacatcaacgaaagcgggaaaatgcctgtcaactttattgccaacactcacacgaccggaggaaactcgggaagtcccgttctcaatgcccgcggagaattggtcggtatcaatttcgaccggaactgggaaggcatcaccggcgatattcaatatcaaggcaattaccaacgctcgataattaccgacatacgatatatactttttatcatcgacaaatatgccgaagccgattatttactcgacgagatgattatcaaaccgtaa

SEQ ID NO: 3045 - DNA, 879 bp, Bacteroides sp.
atggaccagtacaacgaaatgctgaaaggttacgacaccgacctgcgagacgatgaaatctctcaaataacgaaaacaatcctgcacgaaggattacgagaaaactgcaatgaagaagtttaccgcttccttttcgggtgcatcgacttgacatccttgaatccgaccgacaatcaaaatcaaatcgccgaattcacccgacaagtaaacgaactggacaatcaaaatcccgaactcaaccatgtcgccgccatatgcgtttatcccaattttgtagaatgtgtacgcatgaacctcgaagtctctgatgtcaacatagcagctgttgccggagggtttccttctgcccaaacatttaccgaagtaaaaatcgcagaagccgctctcgccgttgccgaaggagccaacgagatagacatagtcatgaacgtaggacaatttctaagtggggaatatgaagatatttgcgatgaaatcgcagaaataaaacacagctgtcatggagatgcccgactgaaagtcattctcgaaaccggagctttgggaaattacagcaacgtaaaaaaagcggccctactcgccatatattccggtgccgactttatcaaaacttctaccggaaaactgaatccaggcgctactcccgaagctttttacgtcatgtgtaccgccatcaaagagtactacgagaaaacacatacccgcatcggaatcaaggccgcaggaggaatctctactacaacagacgccataaaatactacacgattgccaaaaacgtattgggagaagaatggctcgataaagagttcttccgcatcggagcaagccgactggccagccgcttattggaatcgatagtaggtgcaggaaagaactga

SEQ ID NO: 3046 - DNA, 3273 bp, Bacteroides sp.
atgaaaaacagaatggtaagtatgagtccgattaaatatagccttttgttgctgtgtttgatgataagttgtacgctgtcggcacagacgagttcgggtttcatatcgggtaaagtatatgaaatatatcaggggaaacacgagccgtcgataggtgtgaatgtttctattgaaaataaccagcgtcgtgtattgaccggcgttacgaccgatgccaacggtgcattctcgttacgtgtcccggccgatgccgctacgatcgtattctcttttatcggtatggagacgcaacgtattgcttataccggccaaaagacgatgacggtggttatggaggcttcttctcaggaattgagtgaagtaaacgtttctgccgaacgggtcgagacgaccgatatgggtatctcggtgcgtgaacagacggctgccacgcagaaaatcgatatgtcgagcgtggtagaaacattgccggtttcttcggtcgaagaggctttgcagggacgtctcgccggtgtggatattttgtcgggtggcgaccccggttcgaaaggttctattcgtatacgtggtacggcaacccttaattccaatgccgatcctcttatcgtcatcaacggtgttccttactcgaccgatatcgatgactctttcgatttcaatacggcgaacaatgaagattttgccgatatgttgaatctcaacccgtatgatatagaaagcattgaggttttgaaagatgcagcttctacggctatttacggaacaaaagcggccaatggcgttttgttgattacgaccaagaaaggtgccaaaggaaaaaccaactttactttctcttcgaagtttacggtaaaggtcgaacccgaatcgatacctatgctcaacggagatgaatatgtcgcttttatgcaagatgctatttggaatacggccaatgcgcaaggtttgcagaattctgcatcttatctcgaattgctttttgatactcccgagataggttatatgcccagttggcgctatttcgatgagtataatgccaataccgattggctttcgcagatcaccaaagatgcatggattttcgataacagcttctcgatgtcgggcggtggtgaaaaagcaacgtatcgtttctcccttgcttatatgaatgaaggcggtaccagtataggtacggggctggatcgtatcacggccaactataatttgacgtatcgtttttccgataaattcaatatgtatgccgagttctcttataccgatacgcagaaagacgaaccctactttgataatgtccgttcggaggctttgcgcaagatgccgaataagagcccttattggatcaatgatgctacgggtgagcctaccgacaactattttatccgccaaaacagcgaagagttccaaggagcatctgatggagataaaaattatcatccgttgattgtggcaaatgagagttacaataagacgacccagcgtgaagagaggattctctatcgagccaattatcagattcttccgggattcagttggacgggttgggtggccatgaagtttaaaacggtcaaaactcgccagttcctgccgcaaacagccggagatttctcgatcgataataccaatgccaattatagctatgacggatattccaataacttgtcgttacagaccgagaataaatttatcttccggcgtcagttcggtgtacacggacttacagctacaggtttgtggcgtaccgaccagtctcgtagttcagaatcggccgaggccgtttatggtgtggctgctcccggaatgtcggatcctattgccggaggtgccattaccaaactgggatcgggtacatccgaggcccgttctatggcggctgtcggtatggtcaactatacattgttcaaccgttatatcgtaagttttacggccaactacgagggtcggtcgtctttgagtaaggccaaccgttggggatttttcccggccgtgggtgtggcttggcatgtacaagacgaggcttttatgcaaaatctcgactggtggacacagtttaagttacgcgccagctggggacaaagcggtaatgctcctaagggtactgctccttatgtgggaacctattcttcgataggtgattacaataccagtgcggctatcgccccgaactcgatgcaactcaacaaactgaaatgggaaacttcgaccgagtacgatatcggtaccgacctcgggttcctcgataataaattgacgatgactttcgattattatcataaggaaacgaaagacttgttgcagaccaaagtgacgataccctcgacagtagggtatgcaagcaatcaattggcttactacaattccggtagattgagcaatatcggttgggaataccgtatcgattacgaaatattccggaacaaggattggaccgtgtcagccaacttcaatatcaaccgcaacgtaaataaaatcatcgagttgccatcgaatattgcagaggagaatttctcgttgaagaacggtgagtatgcccaaagactcgaacccggtgttgcggtaggttcgttctacggtttccgttatcagggcgtataccagaatacggccgatacctatgctcgcgatgccgaaggtaatgtgatgtatgatttgcagggaaaacccattgtcatgaagaacggatcttatgtatgttatcccggtgatgccaagtatgaagacatcaatcatgacggaaaaatagatgcgaatgatgtcgtttacatcggtaacagtaaccctatgctgaccggtggtggcggattcaatgtcaaatacaggggcttgggactgacggtattcttccattatcgtttgggacaaaaagtgatcaatcaggctcgtatggattcggaggctatgtatggtcgcgacaaccaaagtaaagccgtgttgaaacgttggcgtacagaaggtgacaataccgatataccgcgcgctctttatgactacgggttgaactatttgggttcggaccgatttgtagaagattgttcgtttgtccgtctcaaaactatctcgctttcttacagtatacctaagcgaatctgcaagaaaatgaagataaacggtttgaacctttttgttacgggttatgacctctttactttttccaattataaaggacaagaccccgaggtcagcctgccatccaaagtaacagatctctccaaagataatgcgcaaacgcctcgcagccgtcgtttttcttttggatttaaccttaatttctaa

SEQ ID NO: 3047 - DNA, 2199 bp, Bacteroides sp.
atgataaaaagcatattacccgttctcgaaatgagttgcgccgtatgtgccaacaacgtagaaagcactgtaaaaaaactcccgggtgtgcggtcggcagttgtaaattttgcagcagagaatctcttggtcgaatacgacccgaccatactatctctcgaaaaaatacaagcagccgtgcaagcagccggatatgatctcatcatatcggaagaagaaaaagaaaaacaacgcgaagccgcctctttgcggcattacaagtccctgcgcaaccgcatgcttgtagcttgggtgtttgctatcccactcatggtcgtttcgatgggcttcatgcacacgccgcatatcgaatgggttttgctcggcctcaccctccctattttgctttattcgggacaatctttctatgttcacgcatggaaacaattgaaacaatgcacgtcaaacatggatacgctcgtggcactgagtaccctcacggcgtttctgttgagcctgcttatgacacttttccccggatattggggcgattacggcatcgaaatccatgtctactacgaagcctcgggtatgattgtcgcattcgtccttatcggtaaattcatggaagaacgagctaagcggagcacctcctctgccttgaaaagcctcatgggattgcaaccgcagaccgctctgaaaattaccgaatcggggaaaaccgaagtgaatatagccactctgaaaatcggcgaccgtattcttgtacgtccgggtgaaaaagttgctgtcgacgggtttgtcatcgaaggggaatctttcgtagacgaaagcatgataaacggagaaccgatccccgccgataaaaaagcgggagacaaagtactggccggaactatcaatcacgacggagttcttacgatagaagcccgtgccgtaggtgcgcagactctcctctctcaaatcgtgcggcgcgtacaagaagcacaagggagcaaagctccggcacaacggttggccgaccgtatcagccgtaaattcgtcccgaccatcatcattctcgcgattctcacatttatcggctgggaatatttttacgaggggccgggcgtactggcatacagcctgctggccgctatatcggtactggtcatcgcctgcccgtgtgcactgggattggctacccccacggctctgatggtgggaataggtaaagcagcccgagaacatattcttataaaagatgccgtcgccctcgaaaaaatgggacaaatcgacagcatcgtcctcgataagaccggcacgctcacacaaggccgtcccgaagtcatcgacatcatatggctgaaaccggccgacgaccgatacatcgacctgctcatcgctgctgagacccaatcgcaacacccattggccaaagcaatcgtttcgcattggaacgatcgtattccgggaaaacctcttatcgaacactttgaaaacatttcgggaaaaggtatcgaaataaaatcccgggaagaaacattccgtataggcaaccgttctttcgtgtttacggattcagctctttcgcccgaaaccgaagaaaaaatttcatcgtggttatccgaagggaaaagcgtagtctactacggcagtcatgaaggaatcatcgccatcatcgccatagccgacagaataaaaaaatcatcggccgaagccgtaacccaattacagcaactcggtatcgaagtgtacatgcttaccggagacaatgaagcgaccgcccgttccgtcgcccaatcggtcggaatcacccgtttcaaagcggaagtactgccacaagataaagaagactttgtatccgacttacaaaaggctggaaaaaccgtcgctatggtaggagacggaatcaacgattcgcaggcattagcctgcgccgacgtgagcatagccatggggcaagggacagatatagcgatgcaagtagcaatggttacactcatgaattccgaccttctcttgctcacacgtgccatacggctttcccgcagcacgacgcgcattatccgagaaaacctcttttgggcgttcatctacaatgtcgtatgtattcctatcgccgccgggatattgttcccgataaacggctggatgctcaatcccatgtgggcgagtgccgctatggcattcagctcggtatcggtcgttctcaacagcctgcgattgaaatggaaataa

SEQ ID NO: 3048 - DNA, 1599 bp, Bacteroides sp.
ttattagaggggcggaaagccccattcgatacaaaacacaaaagaattatggcacaacaagaagatgtctttaagaaactgatttcgcattgtaaagaatatggattcgtatttccgtcgagtgaaatatacgatgggctgagcgccgtgtatgattacggacagatgggggtcgagctgaaaaacaatatcaaaaaatattggtgggacagtatggtgctgttgcacgaaaatattgtcggtatcgattcggccatttttatgcacccgacgatttggaaagcgtcggggcacgtcgatgcgtttaatgacccgttgatcgacaataaagactcgaagaagcgttatcgtgccgatgtgcttatcgaggatttgattgccaagatggacgaaaaaatagagaaagaggtggaaaaagccgccaagcgattcggtgaaagtttcgatgaagcgcttttccgtcagaccaatccccgtgtgcaagagcatgtcgccaaacgggaagagttgcattcccgctatgcgaaagccatgaatgaaaacgatttgaacgagttgcgccagattattctcgattatgaaatcgcctgtccgttgagcggtacccgcaactggaccgatgtacgccagttcaatctcatgttctctactgagatggggtctacggccgatggtacgatgaaaatatatcttcgtcccgaaacagcgcaaggtatttttgtcaactatctcaatgtgcagaaaactggccgtatgcgcattcccttcggtattgcgcaaataggcaaggcattccgcaatgaaatcgttgcccgccagttcattttccgtatgagggaattcgagcagatggagatgcaattttttgtgcgtcccggcgaagaactgaaatggtttgcccaatggaaagaaacccgtcttaaatggcacaaggctctcggcctcggcgatgagaaatatcgttatcacgaccatgaaaagttggcacactatgccaatgccgctaccgacatcgagtttgaaatgccattcggattcaaggaagtcgagggaattcattcgcgtaccaatttcgacctgtcgaatcacgaaaaattttctggtaaaaaattgcaatatttcgatccagaactcaacgagtcgtatgtgccctatgtcatcgagacttcgattggcgtcgaccgtatgttcctgagtgtaatggcgggttcgtattgcgaagaacaactgcccgatggggaaactcgtgtggtattgcggctcccggctgcattggcacctgtcaaattggcgatattgcctttggtgaagaaagacggtctgcccgagaaagctcgcgaaataatggatatgttgcgattcgatttcaaatgccagtacgatgagaaagattctatcggcaaacgttatcgccgtcaagatgccatcggtacgcctttctgcgttacggtcgatcacgatacgcttaccgataattgcgttacgatacgtttccgtgatacgatggagcaaaaacgtgtggccataagcgatttggctcagattatcggagagcaagtttcgatgaaatcgttgctgcggaaaattgtgaacagctaa

SEQ ID NO: 3049 - DNA, 1392 bp, Bacteroides sp.
atgaaaaaagaacagattttgaattttctgaaatcaaaagacatttggttctggatcgccgctgctatgctcatggcattattggcgttcgtcctccacgactgcgcctatgctttggccgccgttatccctacggcatcgggaagaatcatttcaggcacgccgctcacaacggaaatcacacgagaatacagtaaagaactcctgatgaacgaggtcgacaaacgcatcaccaaagttcgtcccatgtcgaccccgatcgaccaactttcccgctatgcaggggctcggaaatcgggttcgatgatagtagactattactcggtcgatgtaaaaccgaccaaagcaatcctcgccgaagcctacaccgagccggcctcgggcagcgctaccatcgccgcacagaaagtacaaataacgactagtaacaacgacattttcgaagtctcggaaacgattctcgtacaaggtgtaaaagggtatgaaagcgatggaaaaacaccctcgaaagccgaccttgtcctttacatttcgagtaaagaagaaaccggagaactcaacgtgtacgccatcaatggaaagaccatcggcaatattaccggttgcgttccctcaatcgaacagggtactacgcttatacgcatgggccgagcagcgaccgaactcgacgtacagacagcccaatttgaggcactgcctgtcaaagaccaaaactattgtcaaatcttcaaaatgcaaatcgagcaatcgacgttccaaaaaatcgccaacaaagaagtggaatgggaattttccgactcggaagaggcggctatctatgacatgcgtttgggtatggaaaagactttcatgttcggtgtaaaaagccgtatttacgactcgaaaaagaaagaagaagtctcgcttacgggaggtatctggtggcaagccggtaaagaatacacattcgaccccgaaaaagaacttacacaggaagaccttatcgacatcgccaaagaagcttttaccggaaacggagggaacaaacggaaaatcctcatcggcggttccgacttcatcggtcgcatcaacaagctcgatgtaaataaaatcgtttcggccgatgaagatttcgtaaaatggggcatcgacttttccgaaatccgctccaaattcgggcgtctctttatcctctattccgaagtcttcgacgaatgcggcatgagcgactacggatttattttcgaccccgaattcctgtcgaaatggtctcacgttcctttcgaccgtcaggtactcgacctcaaaggtgccggcgtgcgtaataccgatgccgtcgttctcaccgaggcaagttgccttaccctgcgttatccggccgcacatatgcgcattattcccaaaaacgcataa

SEQ ID NO: 3050 - DNA, 1800 bp, Bacteroides sp.
atgataggaaaaatacggtccgacctgatagccttatgctcgttgatacttttggtactatttgatattcttactccggcagaagctttgagcggattttccaacagtgtcgttatcatgatggtcgggctgtttgtcgtaggaggtgcgattttccaaacgggattggccaaaatggtaagcggaaaaatcatgaggacggccgggaagaatcagttccttcttttcatactggtcatgttggtaacatcttttgtcggggcatttgtgagcaataccggtacggtagctttgatgttgcctattgtggtaagtctggccaatagtgccgatatgtctccttcgcgtctgcttatgcctctggcttttgccagcagtatgggggggatgcttacgcttataggtactccgcccaacttggtcattcaggaagctattgtagacgccgggctggaacccttgtcgtttttctctttcaccccggtggggcttgtgtgtatcgcggtcggtattattgttttgataccgttgtcgaaatggattctttcccgaaagaaacgccaggctgaggacgaaaaaaagtcgcacccttctatggcagaattgttgcgagaatatcagttggaacagcgccttttcagagtacaagtacctgccgactctacttattgcgggaaaatgttgcaagagttggatatttcggagaaatacggtgtcggcattttggagatacggcgtaaaatctctacgcgccgccattttttcaataatatctacgatcatataacagccggaccgcataccgtgatacagagcggcgatatactctatctgtcgggtgatgccgaacatgtttcccgaatgattggagataacgctttgtggaagctcgatacgatatacaatacgtccgagtcggataagatgaatcagacgggagtagcggaagttttgctgttgcataattcatcattgcataacgtggcggtgcgcgattgtggcttccgggaaaaattcaatatcaatatattaggtatacagaggaacgatacctattatgtacatgacttgcgtgatttccgtatgcatagcggagacgccttgttgatacagggagagtggagcgatatagcccgcatgagtagggagcagaacgattgggtcgtattgggacaacctatcgagcaggttgccaaagtaacgatcgatcgtaaggcgcctgtcgctgccggtattatgttgcttatgatattagcgatgattttcgattgggttccggcggtgatggcggttatcatagcagctgtattgatggtatttaccgggtgcttgcgaaatgtcgaggatgcctatcgtacgataaattgggaaagcatcgtactgattgccgccatgatgcctatgtcgttggctttggagaaaaccggggcttcgtccggaatatctatggctcttgtttcgggactcggagagtatggtccattagcattgttggcaggaatttattttacgacatcattgatgacaatgtttatcagcaatacagctacggcggtgcttttggctcccattgccatgcaatcggcagtcagtctgggtgtgagtccctatccctatctttttgccgtaaccgtagcggcgagtatgtgttttgcttcacctttctctacaccgcctaatgcgttggttatgtcggccggtaaatacacatttatggattatgtcaaggtgggattgccgttacagcttgttatcggtatcgtcatgatattcgttttaccgttgttgttccctttttag

SEQ ID NO: 3051 - DNA, 1377 bp, Clostridium sp.
atgagtaattcagcaaaaatgtcagcaaaacagcgcattgaagcacttgttgacgaaaacagttttgttgagatcggtggtttgatcacaaagagaaatactgatttcaatatgcaacaaaaagcagtgccagccgatggtgttattaccggttatggtgtcattgattccaatttggtttatgtatacagccaggacgtgacagcaatgggcggttcggttggagagatgcacgcaaagaagattgccggtctctatgagatggcagtgaaagcaggagcacctgtgatcgagttgatcgattgcgcaggaatccgtgtccacgaagcgtttgacgcgctggcaggctttggagagatttacatggccaaagtaaaagcatccggtattattccacagatcagtgctgtgcttggttcttgtggcggcggtgtggcagtggcatctaagctgtctgatatcacactgatggatgcagagaatggaaaattatttgtgaattctccgaatgcggtacttggcaaccgggaagaaaaatgtgatacggcatctgctaagttccaggcagaggcgggaaatgtagatattgtatgtgacagtgaaggcgaagtgctttctaagatccgtgagcttatcggacttcttccagccaatgcaggtgcatcggcagaggaggaaacagcggatgatatgaaccgcatgttagacggatttgatgcgtataagaccgatgcggctgcggctttgacacagatcgccgatgagaaccgtttcatccagctgaaagaaacttatggaccggaaatggtagtaggacttatgaaactggacggagcaaccgtaggagccattgctaacagtaaagaaggcgttttgtcaacagctggatgtaaaaaagcagagcagtttgtatatttctgtgattcctttggtatcccggttattacattgacaaatgtgaaagaatatgcctcttccatggaagaagagaagactatttcacaggcagtagcggatatgatgtatgcttttgccagtgcagatattccaaagatcaatgtgatcaccggagaagcatatggaagtgcttatgtagcaatgaactccaagcatgttggtgcggatttggtactggctctggattcagctaaagtcggtgtaatggatgccactgtagcagcacaggtaatgtgtcaggatgagattgcgaaagaggctgatacaaagagtgcattggaagagaaagccaaggagtttgaggctttgcagaatggtgccgaaggtgccgcacgcagaggttatgtggacaatgtgatagagggaacttctgtacgcaagcatttgatctatgctttacagatgtttggaatgaggtga

SEQ ID NO: 3052 - DNA, 1419 bp, Clostridium sp.
atgagaaagacaaaaattatctgtaccattggtccgtccagtgaaaatattgaaacattgaccaaaatgtgccaggaggggatgaatgtcgcaagactgaatttttcccatggcagccacgaagaacatcagaacaagatcaatctggtaaaagaggccagagaaaaattaaatatgcccattgccctgatgcttgataccaagggtccggagtaccggatcaaaacctttgaaaacggaaaaatagagttaaaagacggtgattttttcacatttacgacagaagatgtagtaggaaatgagaccattgtatctgtaaactacaaacagctgatgcagaatctggaagtaggcgataccatcttggtaaacaatggactggtcatctttaagattgtagaaatagatgataaaaaggcacgctgtatcgtcgtttcaggcggcgagttaagcaatcgcaagagcatgaatttcccgaaccgggttatggctcaggattttctcagcgaacaggatcggtctgatcttctgttcggtattgaaaatcaagtggactttgtggcagcttcctttgtatcccgaaaaaaagatgtggcagatatgcgccgtttcctggatgaaaacggtggggcggatattgatatcattgccaagatcgagaaccgttccggcgtggaaaacattgaagaaatctgtgagatcgcagatggtattatgatcgcccgtggagatctgggcgtggagatcccggccatggaggtgccgtcggtgcagaagtacctgatcaacaagtgccgtcttcttggcaagcgtgtgatcacagccacagaaatgctggaatcaatgatccacaatccacggccaaccagagcggaactttccgatgtggcaaacgccgtgtatgacggtacttccgctgttatgctgtctggtgagacggcagccggtaaatatccggtggagtcagtgcggaacatggtccagaccattgaatttacggagaaaagcattcattacgacagacggttcaaggtggcggattttgccattaagaacaatgtggatgccgtgtcccacggtacatgcgccatggcagtagatgtaggagccaaatgtatcgttgtaaactctttgagcggccgcaccgtccgcatggtaagccgttttcgctgcccggtggacattataggaatgacccattcggagaaaggctggagaaaactgaacctcagctggggggtaacaccggttttgtgtaagaaatacgactcgattgaagccatgtttgcagacgatctgaagcaggcaaaagaggtgttcccattaaaagagggagacaatgtagttcttaccggtggattgctggacggaagttccggtaccaccaacatgatcaaggtagagcggatcgacggatag

SEQ ID NO: 3053 - DNA, 1932 bp, Clostridium sp.
atgatattagcatgtaatcatatttttaaatcttttggagagacaaccattctcaaggatgcctcttttcatattaacgagggagaacgagtggctatggttggcattaacggtgccgggaaaaccacaatgctccgcattatcatgggtgaatatgacgcagatgagggagaagtgatccatggcaaaaacacaaccatcggctatcttccccagcagcaggggtatcattccgatctgagcatttacgaagaacttctggccgtcaaaaaagatgtgatcgatctggaccgccagatccggcagctggaggaaaaaatgagttctctgtccggcccggaactggaacagacactgaatcagtaccacaggcttcagacaacctttgaaaacggcgacggttacacttataaaagtaaagtattaggtgttattaacggactgggttttggcggagaagctatgcaccagtgtatcaatcatttgtcaggcggccagaaaaccagagtagcactgggcaaactccttttgacggaaccggatcttctgatcttagatgagcccaccaaccatctggatatggaatccatccaatggctggaaacttatctgatcaactataaaggcagtgtccttgtggtgtcccacgaccgctactttctggaccgcattgctcagaagatcgtggaactggatcacggaaaggttaccagtttcaaaggaaattacagcgattattcggtaaaaaaagctgctctcagagaaactttgatccaccagtactacaaccagcagcaacagatccgtcatcaggaacaggtcattacaaaactgcgccagtttaaccgtgaaaaatccattaagcgggctgaaagccgtgaaaaaatgctgaacaaaatggaccggctggaaaaaccggtagaatacgaaaaaaacatgtctttttcactggaaccatcctgtctcagcggcaaagatgttttatctgtcactgattttgccaaaagtttcggcgaaaagcaccttttttctcatgtggactttgaaataaaaagaggggaaaaagtggctattataggccagaacggcaccggtaaaaccactcttctgaaaatgatcaacggcatggtgccggtagatgagggagaagccgtaaccggaagcaatgtagaaatcggctattacgatcaggaacacagtgtactgcacccggaaaaaactatctttcaggagatccaggacgattatccggatctaaaccacacgcagatccgtaatgtgttagccgcctttttgtttaccggtgatgatgtattaaaacccatccaccagttaagcggtggcgagaaggggcgtgtttccctggccaaacttatgttgtccaaggcaaacttccttttactggacgagcctaccaaccatctggatattacttccaaggaaattctggaaacagccatcaataattatacgggaacggtcctgtatgtatcccatgaccgttattttatcaataaaactgctacccggatcctggatctgacccacgaacagattctttcttatgacggagattataactattatctggaaaagaaagacaccgtagaatctatccatatccaggaggatacggccacccctgtttcctccggcaaagcagaaacttcttccaagacagactggaaggcacaaaaagaactggaggctaaaaaacgcaaagtagaaaatgctgccagacaggcggaggaaaccattgccgcactggaacaggacatggaaaacattgatgaagagatcgccctgccggaaaacgctaccaatgtaggccggctcaccgaactcagccgtgaaaaagaagaaaaagaagctgccctcactgaaacaatggaacagtgggaacagcttatggaacagttagagtccttttaa

SEQ ID NO: 3054 - DNA, 1347 bp, Clostridium sp.
atgtacatggctaaatgggataatttacttttatttaagaaaaattctgcggaggattatctgaagacggcgcagaatgtggcggcctggctcaagaaatacgaagtcaaaaagctggtaggaaaaagctgggagatccgcagcggagcaggatcggatgaaggggatgacctggcaagcaaaatgaccgaccgaagcatctactccggagcggcaggcattggctttttctacatacagctttatgaggcaaccgatgataaacagtatctggatgaagccgtagaagcggcggagtatctgctgggaaccttccaaaaggagctgggtgtaaaacccgggattcatggaggaattaccggagagggatttttcgctgagacgctgtatcagaaaacaggggagcagaaataccgcgattacgccattcaagtaggagatgtggcttacgagacggctgtgaaagaagatggaaagatccactgggacaatctggtagattatatgggagatggaagtacagctgtttactggctgcagctggcagaaatcaccggagatcaaaaatacgttacctacgccaaagaattgatcgactatatactgaccttcaaaaaggatcagccggatggcacatcctactggcgtttttttgatattcatgattactttccggagcttccggcaggagggatccttccaaatttcgcccatggaaccgccggtatcgtatatctgcttactaaatattatgaagcgtcaaaagatggatcgtatctggatattgccaaagcaggctttgaatttttgaccaacatcgccattcaaaaagaggacggtgctatcgtgccgtacttgtatttgccggattcagacgaaccgtgggatgtcttttatttaagtatctgccacggaccggtgggagacgccattgtggcaaaagaactatatcaggccacgggagacaaacaatacctggatttctacaaaaaactttccaacgccctggaagcagccggtgtcacttacaaacggtcaccgggttactggaacgactgcatctgctgcggatccgccggtgtatttttgcactttgtggacggatacaggctgacaggagaaaaaaggtatcagcagctggcagaaaaagtggcagacaagctgatcggagacgcctataaaaatgcagagggaaccagatggtatggtgcctggacccgcgtgatcccatggaatgtggatgcgtacaccggcttgtatatgggaagtgccggaggtgccagcgcgttattgtccctgtatggaactttgacaggcaaagagatcacaccgatttttgaatattaa

SEQ ID NO: 3055 - DNA, 1548 bp, Clostridium sp.
atggaactaaaggaaaaacagattcaagaacagaattccacagcgcgttttgtcagcactgtgatctgtatcagtctcttggtggtttctgctatgactttcatcagagtgatccacccggtgatcgttgtacgaagcgtcatcatcttattgactatcattattaattttgtagcaccaaagatcattaagagcggcaaggcatgccggcacatactgaacataaccacttatctttcgtatgccgtgacactgtttaccgccagcaatatgtacatgtacacctatgtgtatctgatcgctataatgatcatgatctactgtgaccgcaaacttctggcactttccggtattctggcatctgttaccatcggagcatttttcacctatcatctcctgacaggctctccaaatttaacactggacattgccattgtacaggaactgatcgtagttgtttccgcttttacagcctatgccatcatccgtctacaagaacgtcacaacagcgagatcctcattgagattgagcgtcgtgcctccgagcagcatatggttgccagcgagatcatgcagcatgccaaagatctgacagagcagtttgaacatgcaatgcgctgttatgaagacctgaacagtggcatggataagagccactccgctatcagcgaaattgatactagttccaaacagaccgcggaatctatttcttatcagacggaccagacactggagatccagaatcatattaaaaaagtggacggtgttaccgctactatgagcgatatttccgctactaccaagcaagccgttgaagaaggcgtggcactgatcgaacagttgaaagcgaaatccaaagatgtggcactgatcagccatgacacagaagttgctaccagagatctgaacaacagtatccacaaggtagaggagattacagatacgatccttggtatttccaaccagacgaatctcctggcgctgaacgcttctatcgaggctgccagagccggcgaggctggtaaaggatttgccgttgtggcagatgagatccgtaacctgtctgaagaaacgcagcaggctaccgagcagatttcagctatcatcgcccaacttaccgctgttgcggaagatgcatccggcaaaatgtccaagtccgctgcctatgcagaagagcagaacgatatgatcgctaagacagaagtgaaacttacaaacattcagacaaactccgatcatttgtttgaaaatgtagcaaccgtaaaaacttctgtagatgatgttctgaaagccaatgccgctatttcagacagtatcacagatctttccgctgtcagccagcaggttgctgcttctaccggaagtaccctttccatcagtgccaccaacatggatgcgttacatagactaaacgaatctctcaacgctattgagacgatctcccagaaaatgtttgcactgatcgagtcttcagatgacctcaacgacagtgcagatgataccactgatgcacagacttctgaaacaaacgaaactgtaagcgaataa

SEQ ID NO: 3056 - DNA, 882 bp, Clostridium sp.
atgacaaagagaagagttttggccatgcttgcatgtggcgtactgacagcaggattattaacaggatgcggcggttcatcttcagacacagcaggagcagatgatgcagagatcacagtagtatcccgcgaagacggatccggtactcgaggtgctttcgtagaattgttcggcgttcaggatgaagacgacaaaggcgaaaagacagatatgacaacagaggatgcgactattaccagcagtaccgaagtagtaatgacgacggtagcaggcaataaaaatgccattggttactgttcactgggatctttgaacgacacagtaaaagcagtaaagatcgatggtgtagaggcaaccgtagacaatatcaacaacggaaaatatgctatttcccgtccgtttaacatcgccaccaacggtacaccaagtgaggtaacacaggattttatcaactacatcctcagtgaagacggacagaagatcgtagaggaaaacggctacataaaagcatccgatgccggtgcatttaagagcaacggagcgaaaggaaagatcgtagtagcaggttcttcttctgtatcaccggttatggaaaaactgatggaagcttacaagaaggtaaacacaggtgctgatgtagaactacaggaaagtgattctacaaccggtatgaagaatgccattgcaaagacttgtgacatcggtatggcatcccgtgatctcaaagacagtgaaacatctgccggattgaaagcaacagtcattgcaaaagatggtattaccgtagtagtaaacaaggaaaacagcatcgacaaccttacaaaggatcaggtcaacaacatctaccgtggcaagatcacaacttggggcgaggttaaataa

SEQ ID NO: 3057 - DNA, 1584 bp, Clostridium sp.
gtggattacaccgtaatcaaacagggtggtaccgcaggagattttacaactcttgtccctttccttttaggagaggggcaggagttttttttattatacaagaaaggaaggtcgttgcatatgacacctacaatggaagagttaaaacagtatgttggacggtatgatattgtaccgattcaggaggaaatttacgcagatgtggtaacaccgatttacctcctgcgaaagattgcagccagcaagaaaaattattatctgctggaaagtgtagaaggtggagaaaaatggggacgatattccttccttggatacgatccgatcatgagagttacctgccaggagaaaaaggtgataatcaaagagggacagaagcaaaaagaggtagagacaacagattccctttcggtggtaagagatatattaaaacaataccaggcaccgaaaataaaggatatgccaccatttgccggcggattcgtaggatatttttcttacgccatgatcgctcatgcagaacctaaattgaagatccagagaggtgaatttgcagattacgacttaatgttgtttgataaagttattgcttatgatcacctgaagcagaaaatcgttctggtggccaatgtaagagttggtgaaaatctggaagaaaactataaaaaagccagaaaagaaataaaagaaattgtatcgctcatccgggatacaacaccacttgaagatgagccggtgtatgataaagtacagtttgagtgcaatgtgacagaagaagaatacgcagggatggtagaaaagacaaaggattatatttttgacggagatattttccaggctgtaatatccagacggtttaccagtgactatgaaggcagtctgatcaatccataccgggtgcttagaactaccaatccatctccgtacatggtgtacatgaatatggaagatgtggagatcatgagtacttcaccggaaacgctggtccgcctgcaggatggcagacttgttaccttcccggtggcaggatccagaccgagaggaaaggatgaaaaggaagatgatgctctggtagcagatctgatgtcggatgagaaagaattgtcagagcacaatatgttggtggatctgggaagaaatgatctgggacggatctcccaatacggatctgtggaagtaaccaagtatcagatgatccataagtattccaagatcatgcatatctgttctcaggtagagagtaacatccgtcaggatatggattcactggatgccatcaagtcggtgctgccggcaggaaccttatccggggcgccaaagatcagagcctgtgagatcatagacgagttggagccggtgccaagaggaatttatggcggagcgttgggctatgttgattttggcggaaacatggatacttgcatcgcaatcaggatggcagtgaaaaagaacaacaaagtctatgtacaggcaggaggcggcattgtggcagacagcgtgccggccaatgaatatcaggaatctgccaataaagcaaaagcagtaatgcttgccattgaaaatgcaaaggaggctgtgagaatatga

SEQ ID NO: 3058 - DNA, 2046 bp, Clostridium sp.
atggaaacctttgccgccgcaacacagaatcgaagtatagataaacaggaggtcataactatgaaaggatatgaaaaatacaaaaaagcttactttatgccaccagaatgtacctacgactgggtaaaaaaagattccatcaccgagccaccgatctggtgctccgttgatctgcgtgacggcaaccaggctctgatcgagccaatgagcttagaggaaaaattaaactttttccagatgttagtagacatcggtttcaaagagatcgaagtaggtttccctgctgcctccgaaaccgaatatgaatttatgcgcgccctgatcgagaaaaatatgatccctcaggatgtgaccgtacaggtattgacccaggccagagagcacattatcaagaaaacctttgaagccgtaaaaggtgctccccacgctgtgatccatctgtacaactccacttctgttgcccagcgcgagcaggttttcaaaaagagtaaagaagaagtaaaacagattgccattgacggtgccaagttattgaaaaaactggccgacgagaccgacgggaacttctccttcgaatacagcccggaaagtttccctggcaccgaagtagactatgccgtagatgtatgtaatgccgtattggacatctggcagccaaaagaggacaacaaagccattatcaacatccctaccaccgtggaaaatgctatgccacatgtatttgccacacaggttgagtatatccacaaacacttgaaataccgcaacgcagttaccttgagcctgcgcccacacaacgaccgcggaagcggtgtcagcgatgctgagttaggtatcctggcaggtgcagaccgtattgagggtactttatttggaaacggtgaaagaaccggtaatgtagacatcatcacactggctatgaacatgttctcccacggcgtagatccaaaactggacttctccaatatgtctgagatccgtcagcgttatgaaacatacacccgcatggttgtgacacctcgccagccatatgccggagatctggtgttcaccgctttttccggttcccatcaggatgctattgccaaaggtatgcagtggcgtgaggacaaaaatctggaagagtggagcgttccatatctgccgatcgatccaaaggatgtaggaagaacttatgattccgatgtgatccgtatcaacagccagtccggtaaaggcggcgtcaactacattttgaaacaaaacttcggcatttctcttcctgctaccatgcgtgaagaggttggttacaccatgaaacaagtatccgacgacgaacacaaagagttgtcacctcagtgggtttatgagatctttgaagatcactacattaacccgacaccacacttccagatcagcgaatgtcatttcaaacaggtagatggtattatggcagaagccaccattttgtatggcgataaaaagaccatcgtagacgccaacggaaatggccgtctggatgcggtcagcaacaccatcaaacagtattttggaatcagctaccagctgtccacctacgaagagcacgctttgacacagggctcctcttccaaagccattgcgtatgtaagcattacctgcaacggtcagacctactggggtgtaggcattgatgaagatatcatcaccgcttccatccatgcattgtgcgtctgcgtcaacaaactgccggaactggcaggcaaagactccggtaaagatgagcgtctcatggaaatgatgaacttcatgcagacaaattaccagaccgtcacactggaagatgtagcgaaagaatttcacctgacagaaccttatgtcagcaaatttatcaaagaaaaatccggcaaaacctttgtggaacagttgaccaagatccgcatgaaaaaagccagaactttgttaaagaacggcaatatgaccgttgaaaatattgcggcatcggtaggttatcccaatgtagagcattttaaccgtacttttaaaaagctctttgatatgacaccgatccagtaccgcaactcctga

SEQ ID NO: 3059 - DNA, 1887 bp, Clostridium sp.
atgaaaccagagatcagctggatcgatgatccaagagtatttcgtgtgaaccagatgcctgctcacagtgaccacactttttatgagtcagaggaggcgtacagagaaggcagaagcactttgaaacaaatgttaaatggaacctggaaattttcctatgcggaccgggtggaccagaggcaggcggacttttacaaagaggactatgacgcctctggatgggacgagatccgggtgccgggacatatcgaactggccgggtatgaccggatcaaatatgccaatatccagtacccgtgggaagggcatgagtacctcagacctccctttgcaccgtcttcggagaaccagagagcggatgttttcagtggatcggattactgcccggtgggatcgtaccggctggagtttgatgtggaagaaggactttgtggcaaggatatttccctgtttttcgagggcgtggagcaggcagtgtatgtctggctcaatggtgtgtttatcggttatggggaagattcttttacccccacagaatttgacttaagcggtgtgatccgggagaagggtaatgtgctggcggtcgaagtatataaaaagacggtggcggcgtacctagaggaccaggacttcttccgtttcttcggtattttccgggatgtgtatctggtggcgagaccggcggtgcatctggaggatctgtggcttcgtcctcagtatgatccggcagagcagaccggtgtgctgtctgcctgcatggatttttccgggaaagagggcggacaggtaaaattgacccttctggatgctgagggccagacggtggcggagaaagaacagccatggaaggaaaagatggaactgatcctgccggtaccggggaaagtcagggcgtggagccacggcgatccgtatctgtatcgtgtggagatccgggtgatggatccggatggcggacttacagaggtcgttccttatgacataggattcagaaagatagagatccgggacaaggtgatgaaactcaatggagagcggcttgttttctgtggtgtgaaccggcatgagtggagtgctgacagcggccggtgcataggggaaaaggaaagacagtgggatatggagtgctttaagagaaaccatatcaatgcggtccgtacctgccattatccggatcagatcccctggtattatctgtgtgacaaagagggtatctacatgatcgctgagaccaatctggagacccacggttcctggggcaaggcggctacactggatgatacatggaatgtgccgggcagcgtgccggaatgggaggccatgacgttggaccgggcaaagactcagtttgaggttttgaaaaaccacacggcgatccttatctggtcccttggcaatgaatcttttgtgggcgagactttgtgcaagatggatcagtattaccgaaaccaggatccggaccgtctggtgcactacgaaggggtgttctggcagccggaatataaaagccgtatgtcggatattgagagccgtatgtatgcctatccaaaggatatacgggagtatctggaaaaagaggcggacaaaccgtttattctctgtgagtacatgcacgatatgggaaattccatgggcggtctgaatacctacatgaacctgatcgatgagtacgatatgtatcagggaggatttatatgggatttcattgaccagtccttgtttgtaacggatctggtgacaggtcagaaggtgctgcggtatggggcagactttgatgacaggccgggggattatgagttctcgggagatggaattgtatttggtgaccgacaggaaaaaccggcgatgcaggaggtaagatattattatggaaaatatgaaaaataa

SEQ ID NO: 3060 - DNA, 1812 bp, Clostridium sp.
atgatatggcttgctgttgtggcaagccttttttctaaacaggggaggaaaaatatgaagattgtgctagttggtatcaatgccaaatatatacatacgaacctggcagtccgttcgttgcaggcaaacgccggaaaataccggaatgaggttgagattgcagaatacaccatcaatcacagtatccaggagattttatcggatctgtttgacagagaaccggatgtggtcggtttttcctgttatctgtggaatattgagtatgtgatgcgtctggctcaggactggaagaagatctggccccagggaaagatcgttgtagggggaccggaagtaagttataacccggaaaagacttttgagcagtatccctttgtggatcttttgatccggggagaaggggaaaataccttcaaagaggtgttggcatggcttcacggggagaaacagtccagggcagaactttccggtgttgcctatctggaagagggagaactgcatataggaccgcctcagaaggcgatggatatggatgatctggtatttccgtatgaatcactggatgggctggagaataagatcctgtattatgagagcatccgtggctgccctttttcttgcagttactgtctttcctctatcgagcgttccgtcaggatcaagagtgtggaaaagacggagaaagaactggacttttttattgagagaaaggtgcctcaggtaaagtttgtggaccgtacattcaactgcaacagggattatgcctatgagatctggcgatatatcggagagcatgataatggtgttaccaactttcactttgagataggcggtgatcttctgcgggagaaggattttgaactgctgaagacattcagaccggggcttgttcagtttgagatcggggtccagtccaccaatccggataccattaaggcaatccggcgcaccatggacttgaagaaactggcagactgtgtggcaagggtgcatgaagcaggcaatatccatgagcatctggatctgatcgcagggttgccgtatgagggatatgcaagtttcagacattcttttgaagatgtgtatgccatgaagccggatcagcttcagttgggatttctgaaagtgttagagggatcctacatgaatgaggtaaaggattcctatgacattcagttcagcagttatccgccctatgaggtgttgtccaccagatggctgccgtatgaggacctgaagcggctgaaagcggtggaagaaatggtggaagtgtactacaacagtttccagttcagtgcatccatgacttacttacggacactgtttagtatggcttttgatatgtatgtggcactgtctatgcattaccgggaaaagggctatttttcctgccagcacagccgtctgagacggtatgagattttgtgggaatttgccattgagtggctgaaaatgacaccggagcagctggaagaattccggcaggtccttacctttgacctctacagcagggattatgtgaaaaatccgccttcttttgtggaactgcgaagcgatgagcagaaaaagaagatccgggcgttttttgacagagaatgtgaagacccacagtatcttcatgggtatgacaatcgtgtgacaaaacagttatttaatatgatttatatcggagaattttcctttgatctgacggcatggcagaagaagggggaaattgtgtttggcccctttgcctggtttatgtttgactatcaaaaaagaaatccgctgaactatagtgccggtgttcagaggatttccatggattcttaa

SEQ ID NO: 3061 - DNA, 1671 bp, Clostridium sp.
ttgagcaccgcagatatacgaaaatgttttctggccggggcaaatgccctggatgccagaaaagaaataattaatgatctgaatgtctttcctgtgccggatggcgatacaggaaccaatatgactatgacgattatgtcagcggcgcgggaagtagctgcactggaggaagatgccgacatgcagcagctttgtaaagcaatatccagtggttccctgcgaggagcaagaggaaactcaggagtcattctttcccagcttttgcgtggctttacaaaagaaataaagaaagcagaagaagtggatgttcaagttcttacaaaggcttttgaacacgctgttgcgtcagcttataaggcggttatgaaaccaaaggaaggaactattttgacagtggccagagcgggatctgagaaggcattgcagatctgtgatggaacagaaaatattattgaactggtaaattcagtagtactttacatgagagatgtgctggatatgacaccggatatgctgcctgtactgaaagaggccggcgtggtggattctggtggagagggtcttctgactattcttgaaggtgcatatgactgtctccttggaaaaaatgtgaattatgacatcaagacagatgaagggatggttccgtctgtttctgccggtgccaaaacggaagcgattgccgatgtagatattaaatatggctactgcacggagtttattattatgcttgagaagaaattttcgagacaggatgaactggagtttaaggcgtatttagagtctattggtgattcgattgtgtgtgtggcggatgaggatatagtgaagatccatgtacacactaatgatccgggactggctatccagaaggcgttgacgtatggctcacttacccgcatgaagattgacaacatgagagaagaacataatgagcgtgtgatccgtgatgcggaccgtaaggcccaggaacaaaaagaagctgaaaaacaggcagaagagatgccgcataaggaacatggttttatcagtgtatccgttggagacggactgaatgacattttcagagaattaggtgtagattatgttatcgaaggcggacagaccatgaacccgagcacagaggatattctggatgcgatttccaaggtgaatgcagataatatctttttactgcccaataattcaaatattatcctggcctgtgagcaggcgaaggatcttacaaaggataaaaatatttatgtgattcccactaagaacattccgcaaggtatcactgcgatggttaactttgtagagggaattactgcttcagagaatgcggaaacaatgaaagcaagtcttagtgaagtgaaggctggtcaggtgacctatgcggtccgggatacatcggtggacggcaagacgatcaaggctggtgatatcatgggactgagtgacaagaccattgagacagtaggctctgatattgtagatacaaccgtggcacttctttctaaaatgctagacgaagattcggaactggtaaccatctatattggacaggatggatctatggaagatgcccggcaaattgaaaaagaggtagagaaaatagacagtgagctggaagtagaaatccagtatggtggacagccgatttactactattttctgtcggttgaataa

SEQ ID NO: 3062 - DNA, 2652 bp, Clostridium sp.
atgcgtaaagaattaggaaaaacatacgatcccaaagatattgaggatcgtttgtactcaaaatggatcaacaaaaaatacttccacgcagaagtaaatccagacaaaaaaccatataccattgtgattccaccaccaaacatcacaggacagcttcatatgggacatgcactggacaatactttgcaggatattttgatccgcttcaagagaatgcaggggtatgaaacattgtggatgccgggaacagaccatgcatccatcgccacagaagcaaagatcgtggaagccatgaaacaggaagggctgaccaaagaagatctgggaagagagaagtttttggagcgtgcctgggactggaaaaagacctatggcggccggattgtttcccagttgaagaaaatgggatcatcctgtgactgggacagagagcgttttaccatggatgaaggttgcaacaaagcagtaaaagaagtgtttgtaaatctttacaacaaaggcttgatctaccgtggcgagcgtattatcaactggtgccctcactgccttacatccatttccgatgcagaggtagagtacgaagaccagcagggacatttctggcatctgcgctacccatttgcagatggcagcggctatatcaatctggccacaacccgtccggagactctgttgggagatactgccgtagcagtaaatccaaacgatgaaagatacaaagacctggtaggaaagatgctgatccttccactggtacacagagagattccgttgatcgcagatgagtatgtagatatggaatttggaaccggtgttgtaaagattacaccggcccacgacccgaacgactttgaagtaggtctgcgccacgacctgccggttcttaatgtgctgacagaagatgctaagatcgtagatgaatatgaaaaatatgccggtatggaccgctatgaggcaagaaaagccatcgtagcagatctggaagcagaaggtgctttggtaaaagtggaggaccacgaccacaatgtaggaacttgttaccgctgcggtacaacggtagagccgagagtttccaaacagtggtttgtaaaaatgaaaccattggccggcccagccattgacgcagtaaaagaaggcaagaccaaatttgtaccagagcattttaacaagacttatttccactggcttgaaaatatccgtgactggtgtatttcccgtcagttgtggtggggacatcagatcccggccttttactgtgacgactgtggagaactggtagtaaccaaggaaaactcctgcacctgtccaaaatgcggaaaagaaatgagacaggatccggatacactggatacctggtttagttccgcactgtggccattttccacactgggatggccggatgatacggaagaaatgaaatatttctatccgaccaacacattggtaaccggatatgacattatcccattctgggttatgagaatgatgttcagcggactggagcataccggtcaggtgccatttgatacagtactgatccatggactggtacgagattcccagggacgcaagatgagtaagtctttaggaaacggtatcgatccactggaagtcattgacaaatacggtgccgatgccctgcgtcttacactggtaaccggtaatgcaccgggaaatgatatgagattttactgggagcgtgttgagtcaagccgtaactttgccaacaaagtatggaatgcatctcgttttatcatgatgaacttccagcagaatgaaaatgttgattacagtcaggttaagaaagaagaattgactcaggcagataaatggatcttgtccaaggtaaacaacctggccaaagatgttactgcgttgatggagacatttgacctgggaatcgccgtacagaagatttatgactttatctgggaagagttctgcgactggtacatcgagatggtaaaacctcgtctgtacaacgaagaagacacaaccaaggcagcagcactgtacacactgaagactgtactggtagacgctttgaaacttctgcacccatatatgccgtttatcacagaggaaatttactgtacactgatggatgatgaagagcagtctattatggtttccgactggccggtttacacagaagaaagaaactttgcagaggatgaggccaaggtagagcgcatcaaagaagcagtaaaaggcatccgaaatatccgcggagaaatgaatgtaccgccaagcaaaaaagcatccgtcatcgtagtgtcagaaaagcaggacgtgctggatatttaccaggaaaataaggtgttctttgctaccctgggtctggcaagcgatgtgacattccagaaggacaaagccggtattgccgatgacgcagtatctgttgtgattgcggacggaactatttacattccgtttgcagaactggtagacattgaaaaagagatcgagcgtctgaaaaaagaggagaaaaaactccagggtgagctgaagcgttcccagggaatgcttggcaatccaaactttgtaaacaaggcaccggaaaagaagatcgctgaagagcgtgaaaaactggaaaaatacaaaggaatgatggaacaggtacagcagcgtctggcgcaacttgagaaatag

SEQ ID NO: 3063 - DNA, 1452 bp, Clostridium sp.
atgggaactattattggtgatggcattacatttgatgatgtgttattagtaccttcatattcggaagtgattcccaatcaagtatgtcttaagacacatttgacaaaggacattgagttaaacattcctatgatgagtgcaggaatggatacagttacagagcatcgtatggcgattgcgatggcaagacagggtggaatcggtattatccacaaaaatatgtctatagaggagcaggctgaggaagttgataaggtaaaaagatctgaaaatggtgttatcacagatccgttttatctttctccggaacatacattgggagatgccaacgatctgatggctaagttcagaatttcaggtgtaccgatcacagaaggaaaaaaactggtaggtatcatcacaaatcgtgacctgaagtttgaaacagattttagcaaaaagatcaaagagtgtatgacaagcgaaggattgatcacggcgccggagggaattacactggacgaggcaaagaagatccttgccggagccagaaaagaaaaacttcctattgtagataaagatggaaatctcagcggattgatcaccatcaaggatattgaaaaacagatcaaatatccaaattctgccaaagacaagcagggaagactgttgtgcggtgccggtgtaggtgtaacagctaacattctggaccgtgtagatgcactggtaaaatccaaggtggatgtgattgttattgatacagctcatggccactctgccaatgtactccgggttgtaaagatggttcgtgaaaaatacccggatcttgctatcatagcaggaaatgtagctaccggagaggccacagaggcattgatccaggctggtgtagatgccgttaaagttggtatcggaccgggatctatctgtactacccgtgttgttgccggtattggtgttccgcagataacagctattatggattgttatgcagtggctaagaaatatggtattccgatcattgcggacggtggtatcaagtactccggagatatgacaaaagcaattgctgccggggcaaatgtctgcatgatgggtagtatttttgccggatgtgatgagagtccgggaacatttgagttgttccagggaagaaaatataaagtttaccgtggaatgggatctatcgctgctatggagaacggaagtaaagaccgttatttccagcaggatgccaagaaattggtgccagagggtgttgaaggccgtgtggcatataaaggtctggtagaagatactgtattccagttgatcggtggtatccgttccggtatgggatattgtggtacaaagaccattgaagagctgaaagagaatggaaaattcgtgaagatctctgctgcttctttgaaagaaagccatcctcatgatattcacattaccaaagaggctccaaactatagtgtcgagtaa

SEQ ID NO: 3064 - DNA, 1701 bp, Clostridium sp.
atgaagaaattttgcaaagcagtattattgttgtccgctgtgacactgatgggaacagcagcgtctgttcaggcagatgccaagacaaaagtcaaagtgtcgaaggtgacagtgaaaagtaactatggaagccgtgttcgtgtggcagtcggcaaaaaaattaaactgaaaactaccgtaaaggtaaagccaaacaaggctgccaacaaaaaagtgacttacaagtcatccaataaaaaaattgctacggtgtcagccagcggttatgtgaagggtgtgaaagccggaacctgtaagattaaggtaacatccaagaaaaacaaaaagaaaaaagcaactataaaggtaactgttgttaaaaaagtaagctccatcaaattagcagcatccaccaaagaaatatatgcaggagaatctgttaaggttacaccaacggttctgccggcaacaggaagttataaaggggtaacatggagttcttctaataagaaagtggctactgttacaagcaaaggtgttgtaagaggagtagcaggcggtacggttactatcacagccaagtcagtagaaggatccggaaccaaaggtacgatcaagatcaaggtattgtccaaagatactgttaatctgaccagcgtagaagtagtagcaaaagactgtgtacgtattagtctgaataagatgaataatctcaataaaaccagttttgccattaccggtaagaagtattcctttggtaaatataacaagaaatataccatccgccgcatccgcaattacgatggaaagaactatgatcttttcctggatcaagatactactattgcagcggacagttatgtgaaagtggatattgcatccttgccgggaaacggaacaaagacaaaggaaacacaggcagttatgctgaataccacagctccgacggaagagtactggacaggcgagacaggagaaaaggtgaagaaaaccatcgacctgagtgaatactgctatggagatgctgcttataccgtgacaggaagtgtgtccggcgtaacatggaaacagtgtggcaaccagttagagttttcaggaacttataaccaggcaggaacaggtgcgttggtgatccgggcagtagatgagacagaccgggttatcaaacagactgttcatgtggcagtgggcgataagaatacgatccaggcgttagacctgaacaaaaaaatggtacagggtacagcctatgaagattttatgacctttaagatctgtggaggaagcggaaagtacagctatacagcatccagccttccggaaggattgaatcttcacagtgacggatctttttccggtacaccggtaagagagggaacctataagattactctgtatgctgtggattcatccaacgcaaatctgaaaaaagaaataccggttactttaacagttgaatcagccaagaaatttgtaggtgttgtaaaagatacagaccaccatccgttagcagatattgtggtaacagtaaaagatagaaaagatggtactatctatacagcggttacgaatagttatggttactattcggttaatgtgccggcgggaagttatgacatcatagcacaaaatggcaatgcatcggattctgtttataacattgtgatcaccacaggaacccgtcagtttgaatttacatttgacaagataacagcgcagtaa

SEQ ID NO: 3065 - DNA, 2163 bp, Clostridium sp.
gtgtttttttgggaaaagaaagatgaggaaataaagatgctggaagaaaaggcaaaaatgttattatcttttttgcaggatgaaaaatacaggccgatgcggatcaaagaactggctgtgttttttggagtgccaaaaaagaaacgaggagaatttcatcaggttattgatgaccttttgaaaaagggatatatacagatcgatgctcatggactggtaggactgcctaaagaaatggtaatgcagggaacttttatggctaccagcagagggtttggatttgtacggacagaagatgaggataaagacgatatttttattcctgagcgttattgcagcaatgcatttcatggtgatatcgtacaagtgcagattaccaaagaaggcaatggaagaagacgggaagaaggccggattctgagagtgcttgagcgcaagacgaccagactggtgggaacttttaccaagaataaaaatgtgacctttgttgtgccggatcaggagaagataaccagagatatttacattgccaagggagataccctgggagcggtagatggtcataaagttgtggtggaactgaaaaattacggagatgaagataaaagtccggaaggaattgtgatccagatactgggacacataaatgatccgggtgtggatattttatctattatcaaaggatacggactgccagaagagtttccggaagatgtaatgaaggagacggcgggaatcccgtatgaggtttcaccaaaagaaatggctggcagagtggatctgcgccacctggatacagttaccattgatggagaggatgcaaaagatctggatgatgctatcactttacaggtgacagaagacggactgtatgaactgggagtccacatagctgatgtgtcccattatgtgacagaaaattctgccctggataaagaggccttgaaccggggaaccagtgtatatctggtagacagggtgatccctatgatccctcacaaactttccaatggaatctgctccttgaatgcaggagtggacaggctggcacttagttgtctcattacctatgatgagcatggaaagatcaaaagacaccgcatctgtgaatcagtgatacaggtaacagagcggatgaactattcggatgtaagggatattcttgtatacgaaaaggaagagacctgcaaacggtacgagccactgatcccgatgtttcgcaatatggaaaaactggctgccattctccgtaaaggacgaaaaaaacagggttccattaattttgattttcaggagtgcaagatccttttggataaaaacggaaaacctacggacattgtgccatatgaccggaatgtggcaacccgcatgatcgaggaatttatgctggcggccaataaagtggtggcagaagattatttctggatggacataccatttttgtatcgaatccatgaatacccggatctggaaaagatccagcagctgtctatgatcacggcaagtcttggctatcacatcaaggtgggaaaagaagaagttcatccgagggaactgcaaaaactgattaccagtattgagggaacagaagaagaggcgtttctcagcaggctgaccctgcgttccatgaagcgtgccaagtattccaccaataatgagggacattttggactggccactaagtattattgtcattttacttcgccgatccgccgttatccggatctgcagatccaccgtatcattaaggaaaatatccgtcacggaattcagggaaaacgatatgagcactataatgatcttcttccgggagtggccatcagcaccagcgaaaaggaacgcagagccgatgatgcagaacgggaagtggaaaaactgaaaaaagctgagtatatgtacgatcatatcggtgagtgctatcatggtgtgatcagcggcgtgacatcctggggtatttatgtagaactgcccaatactgtggaaggcatggttcggatttctgagatggaagacgaccagtatgagttccaggaagagcgttaccgggttgtaggccactacaccggtaaagaataccgtatgggacagccggtatatatccgggtagagcaggtagacagagaattgagaaccattgattttgttatgatgcaggaggaatag

SEQ ID NO: 3066 - DNA, 1008 bp, Clostridium sp.
cgcgttggagaaaggaagagcatgaagaaagcagtgagtcacagatgtgtggatccgggacaaagaatccgggaaaaacacaaaatgagatgtatatcggcattttttctggcggtgggtatggcactgctgttgtttgtgtgcgcaggtgtgtggcaggggaaaaattatctgctggcggggattcttatgctgctttttttgttcggtgtggttgtgttgaactttgaaaaacgaaaacccagagccagggagatcgctcttttgtctaccatgaccgggttaagtgtggcggccaatgaattgtgcagtcataccattccccttcatgcaggaactgccatggtagtgatcagcggcatcgcactgggaccggaaaccggatttttcgtaggggcactggcccggtttgtctgtaattttttctccggacaggggccgtggacgccgtggcagatggtttcctgggggctgatgggatatctggccgggctgtgctttaataccatccgggtccgggggcggctggaagaggaaacgctggccgggcgtttttccctgaagaaaaatacatctttccgcctgctggcaggtcctctggcagcgatagcggggggagagatattgggatatcttctgtatgtgtggacaggagtgcagggagagacattctggggctggcgtgtgtatgtgtttggctttttgggacttgctttcggcatagtgcttcaaaggaaaaaactgccggtagatccggtgacaacttcggtgtttgtttttcttattacggtacttgtgtacgggggaatcatgaattttgcggcgatgcttatgacggcccaatccggcggggaggtaagtgtggtggctctgaaggcgttgtatgtgaccggccttccctatgaccttatgcatggagcgggggcggcgttgtgtatgttttttgccggtgatgtgatattgcagaaattacagcggatccagattaaatttgggattggcttttaa

SEQ ID NO: 3067 - DNA, 1500 bp, Clostridium sp.
atgagaggaattgatacaccgattcgacagatccgtcggcgggttttcgaggaagtcgcgcgggtcgcatttgagtcagacaatttgaatgatgatattgaagcactaccttatattatagcacccagcgatctccccacatatcatgagagtatatacagagagagagctattgtgtcagagcgggtaaggctggccatgggactttccctgcggccggatgatgagccggtgcatctgacagcggggctggatgccagtaatgtggcggaaaagtattatgagccgccgctgatgcaggtgataccttctgcctgtgacaagtgtccggataatatttatgaggtgtccaaccagtgccgcggctgtatggcccatccttgtgcagaagtgtgtccaaagggggctatcagtatggtaaaaggacagtcttatattgatatggaaaaatgtatccggtgtggaaaatgcaaggccatttgtccttacgatgccattgcaaagaaagttcgtccgtgttcggcggcctgcggtatcaaggccattggaacggatgaactgggacgggccaagattgatgataaaaagtgtgtaaagtgcggacagtgtatggccagctgtccatttggcgccattgcggacaaatcccagatttttcagctgatccaggccatgaaacaggggcctgtctatgtggaactggcgccggcagtcatcggacagtttggtgcagatgtgcggctgtggaagatcaaagctgccttgaaagaagtgggatttgccgatgtgtacgaggtggcactgggagcggatattggcgccagcacagaggcgaagcagtatgtaaatgaggtaaaaagcggcaaaaagccgtttcttcttacatcctgttgtccagcctggtccgttcttgccaaaaggactctgccggatatggtagatacagtgtccaatgctctgacgccgatggttgccacggcccggatgatcaagcagagacatccggaagggaagattgtctttgccggtccctgtgcagctaagaagctggaggcatcccgtacttctgtgcgcagtgatgtggattttgtgattacctttgaggaactggcggcaatttttgcagcaaagggcattgatctggagacttacgaatgtgaggaaccgatccatgatgccacaggagccggaagaggttatgccattgccggtggtgtggccagtgccattgagcagtgtattgaagagtattatcccggcacggaagtttatattgagcatgcagaggggctgtcggagtgccagaagatcctgatgcttgccaaagccggtaaaaaggatggctgccttattgagggaatgggctgtccgggaggttgtgtagccggagtaggaaccaatattccgataccaaaggctacaggagcggtgaaaaagtttgtaaaagattctaccactccactgccgccgaaagagtattcaaaaatagagttaccatga

SEQ ID NO: 3068 - DNA, 1968 bp, Clostridium sp.
ttgccatcaatcagaaccattgtctacattgcaggagctgtgcagatatcatttgaattgcgaaacgacttaaataagagtataataaaatcagtatttgaaaaaaaagatcaaatggaggggaacatgagtcgtttagttatgaggacagtaagcaagtcccaggaagtggtagaggacttgtacaaagtattggagcgtcggatcgtagccagtccaccgggaatctgcccggtggatatttcggctgcttttttgaagttgtgccatgcccagagttgtggaaagtgtacaccttgccgaatcggactgggccagctggaaaatcttttggagcaggtgttagacggagaagcagacgaggagacacttattttgatggaaaagacagccagggccattgagattacggcagactgtgccattgggcgggaagcggccaggatggtgttagcgggaataaaagggtttaaggatgactttgaagagcatatccaccacaaccgttgtctgtgccatatcaagcagccggtgccatgtgttgccatgtgtccggcaggagtggatatcccgggttacatagcattgatcaaggaaggaagaaatgccgatgcggtgcgccttatccgtaaggacaatccatttcctacagcttgtgctctggtatgcgagcatccatgtgaggccagatgccgcagaaatatggtggatgatgccattaatatccgcggcttgaaacgggcagcagtggatcatgcaggagaggtgccggcaccagagtgtgcaccgtctacgggaaagaggatcgcagtgatcggtggcggtccatccggattaagtgcagcgtattatctgcagctgatgggacatcaggtaaccgtatatgagaagcgaagcaaattaggtggtatgttgttatatggtattccaagttaccgacttccaagagagcgtctgcaggaggatgtggatgtgatcttgtctaccggtgtcgtggcaaaaacgaatacgaccattggtggtgaaaatggggaaatcaccatgcaggatctacgggaacagtatgatgcggtgtatatttccataggagcccatacggataaaaagatgggcattgaaggagaagacagtcagggggttatttctgccgtggaaatgctccgggaagttggaagaaaccggatgcccgatttcaagggaaaaagagtggttgtcattggcggcggtaatgtggccatggactgtaccagatcggctattcgtttgggagcagataaagttatctgtgtataccgaagaagaaagaaagacatgacagcgttgccggatgaggtagaaggagctatcgccgagggcgcggagattttggaacttcatgcgccggaacggatccaggcagatgaaaatggaaaagtgacagccttgatcgcatcaaagaaaatggcagggctgatcaaaggaggcaggccttctccggcagcttccggagagggagaggctgccataccatgtgatgtagtgatcgttgccattggacagggaattgagaccagacattttgaggatgcaggtatccccatcaagcgaggcgttatcgaagccgagaactgggcagaagtagcccatgccccgggtgtatttgccgggggagactgtgtaacaggaccggctacggtaattcgtgccattgcggcaggaaaggtggcagcggccaacattgatgagtatcttggatactctcatgtgatccgtgtggatgtggatattccgatgccaagtctggaatctatgccaccttgcggaagagtgaacttgagagagcgggatgcggcaaagagatgccatgatttcgatcttatggaaatcggcatgaatgagaaggaaatccagcaggaatccagccgttgtctccgttgtgattattatggttacggaatctttaagggaggcagagaagacgaatggtag

SEQ ID NO: 3069 - DNA, 1506 bp, Clostridium sp.
gtggcaaaactgattattaatgaaaccaataaactggatcgaatcgagccggaaatttatggacacttttcagagcatctgggacgctgtatttatgaaggaatttatgtgggtgaaaactcagatattcccaatgtaaatggaatgagaactgatgtagtagaagcactgaaggagctgaaagttcctatgcttcgttggccgggtggctgttttgcagatgaatatcactggaaagatggtattggaccaaaggaaaatcgcaaaaaaatggtaaacacccattggggcggtgtggtagaggataacagtttcggaacccatgagtttatggagttgtgtcgccagcttggatgcaagacttacatcaatggaaatctgggaagcggtactgtacaggaaatgtcagagtgggttgagtatatgaccttcaatggtatttccccgatggcggatcttcggaaagaaaatggcagtgaggagccatggacagttgatttctttggtgtaggaaatgagaactggggctgtggtggtaacatgacaccagagcactatgctaatgagtacagaagataccagacttatgtaagaaattacgatcctaagaaaccgatcaagaaagtatgctgtggtgccaatgtagaagattacttctggacagagggtgtcatgaaaacagccttctcccatgcagagcagttccatggatttatggattatttgtcactgcactattatgtgcatccggaaggctgggaaatcaaaggatccgctacagacttcaatgaagaggtatggtataagactttgaataaggcattgtttatggatcagttgatccgcaaacatggtgctattatggatcagtatgacccggagaagaaagtgggcatgtgtgtagacgaatggggatcctggtatacatgtgaggctggaaccaatcctggattcttgtatcagcaaaataccgtccgtgacgctttgattgcaggcatcactttgaacatcttcaataagcactgtgaccgtgttaagattgcagcactggcacagatggttaatgtattacaggctgttcttctcacagagggagatcagatgatcaagacaccgacctatcatgttatgcacatgtaccgtcatcatcagggagcaacactgttggaaagtgctgtaaccggtgtggaagagatcggtgtagaggactggaaagttcctaagatcacagaatctgtatcgatggatgcagatggtattatcacgattactatgaataacctgtccatcgagtcagaagagacagttgatatccagctggctgaaaatggatacaaagtagcggaggcaaaggttgtgactgaaaatgatatgcatgccatgaatacatttgaagcaccagagacagtaacagagaaagatctgacaggatatacagagacagcagaaggaattcgtgttgttatgccgaagaacagtgttgttgagcttcgtctgaagaaataa

SEQ ID NO: 3070 - DNA, 2286 bp, Clostridium sp.
gcaaatctttctgccacaggacggaacctaaccccgacagccccccggaagaaaattgacatccccatagggataaagtataattttcacaacattgttttgattggaggattttttatgtttggttctatggcaggcaaccttatggggattttgtactttcttttgtttcagtttatgggtatcatcattgcctccttattcctgaaaaaagaaaagtggggatttactttactggccggatcggttttaggcagtttttcgctgcagtggattccggttcttttcgcctttttccttggtttcagtaaaacagcccacattctggctctggcagccatggctcttgtgaccgcctttttgtggctgaaagtatccgactgtgactggcgcagcggacggtcttttcatatttcatgtaagcagtggatccttaacgatcccattatcctgcttttgatcccggtctttttgtttaccgccgttatgctgacaggccatactctgtctgcaggggagggactttcccttcattccggtcagagtacctatggtgacatgaatatgcaccttggctttatcacaagcattgccaaacagcagatcttcccaccggaatattccatcttgccgggtacaaaacttgcctatccgtttttgtccgacagcatttcctccagtttgtatttatttggcacttcgctgcgggtggcctacctggttcctatgtatgccgctttggcgcaggtgtttttcggtatgtatgccgtagccaaaaccatctatacaaacctgggacttagttaccggggcaaatccatccttgccttcgccttgtttttcttcaatggcggccttggattttactatttcatcaaccagggatttaacagtgaaaacttccgccggatctttactgctttttacgaaactcctaccaactatgttcaggccaatgtacaatggcacaatgtgatctgcgatatgctgatccctcagcgggctaccttgtttggctgggctgttctttttccggttcttgctctgatactaaagggccgtagacaacacgataaaacatattggatcctgtctgccatcctggcgggagggctggtgctgatccacacccattccttcctggctctgggcgtttgctgtgccgtttttgttgcccaggatttggcctctctggcggggaaaaaagccccttccctttccctgtcatggcgcgctgtccttgtctgtggcgtgctgctctttttacagtttgtcagtgttcgtcagctgtccgaagaacctttttccggttctatgctgctgactttcggttatatgattttgctttgcttttttgccatcctgggtgttcttacctacaacagccaggatgtctggaaaaaagataaaagtgtatggctgcgctggggcttctttttagccattgttttgctgcttgccctgcctcagcttttcggctttacattccgtcaggcacagggagaacagtttgtccggggcggtttcaactgggctaattcaaatccggaagttcaggatacttactttattttctatctgaaaaatctgggcatcatgttcctgcttccgattctcctattgatcttcgggaaaaaagaacaacggcatatggccatgcccggcgtacttctctggcttttgtgcgaatttgtcctgttccagcccaacagttatgacaacaacaaacttttgttagtagcatacctgtttttctgtattgcctcagccgattatgtgtgggataccctgccacagcattttgccagactgggacgctttgtccggccggccgctgtagcggttaccgccgtcctcggcgtctttgccgccatccttaccatgggacgggagtgggtttctgactacgaattgtatgacaacggttatgtaaaagcctgtcagtgggtggaaaaaaacacacagccaactgatacattccttaccgctaccaaccacaacaacgccattgcctctcttaccgggcgcaatatcgtctgcggctcttcttcctttttgtactaccacggagtggattataccggcaatgaagcagcagtcaaatccatgtacgaagatccggatgccagagattctctgctggatgagtacggcgtaaattatattgtgatcggtccctgggaactgggcagttaccagatttctgactatgacacgctggccagttcctacgaaatcgtttacagccaggacaacattgtcatcctggctgtaaatgatcgataa

SEQ ID NO: 3071 - DNA, 1374 bp, Clostridium sp.
gaggaaacgaaagtgaagaaaaaatctacagaaatatttgaaaatgcgccgattcccaaggcggtcttcttaaatatcattccgtccattgtcagtatgcttatggttttagtatataatctggcggatactttttttataggacagacaaaaaatgcattgatggtggcggccgtatcccaggcaacaccggcctttttactgtttatggcgattggtatgctgtttggtatcggtggaacttccctgatctcccgtctgttgggacagggacgaaaggcggaaacaaggaaagcctgttctttctgcttttggaccggattaggcgtaggtgttgtgggaatgcttgctattctgatcttcaatgaacctatttcatggctggtaggtgctaccgaaagtaccattgaatatgtaagacagtatctggtcattgtagcattcggtgtaccgtttttgatcatcggcaatgtattcagtaatgtgatccgtgcagaaggcagtgccaataaggcgatgatgggaatgatcctcggaaaccttacaaacattgtgttagaccctattatgatcctgactttcggatggaatgtagcaggtgctgctatcgctaccgtactgggcaatgtagtcagtgccgtgttttatattagtcatttcatggggggtaaatctgagcttactatcagcatccgggaatatcaggcgaaacaccagattgctaccggcgtgctggcaatcggtataccggcgtctcttaatagtatgttgatgagtgtgtccaatgtgctgatcaacaatctgatgaaagagtatggtgatatgtctgtagccggtctgggtgtggccatgaaggtaaatatggtggccgttatgcttttgatcggtcttggtaccggcatccagccgcttcttggttacaactacggagcaggaaaccggaaaagatacaaagggatccttcgtttttctcttatctttgctctgtgcctcagcctggttatgacgatcctctgttacctgggggcaggaccgatggtcaaggcttttctggaagataaagaggcctttgattatggaatgcagtttgccagaacactgatcatatccggtccggtgctgggaattttgttcgttatgatcaatgccatccagtcactgggagcggcattgccatctttgatcttgtctatcagcagacagggacttttgtacatcccggtcctgtacctttttaatacctgttttggaaatgccaaaatgcttgtgatggcacagccggttaccgattatctggctactatactggccatcgtattatttatagtagcattcaaaaaatattttaagaaaaatgaaggaaacgaggcttaa

SEQ ID NO: 3072 - DNA, 3573 bp, Clostridium sp.
atgggtcagacaaattggacgagtgagcagagagaaatcattgatgccagaaatgagaatattctggtgtcggcggcagcaggatccggtaaaaccacggtgctagtggagcggatctttcagagaatgacagacccggtgaacccggtagggattgaccggtttgttgtggtgacatttaccaatctggcagcggcgcagatgaaggaccggctgcggaggcgtatcgatgaagaactggcggcccacccggataatgaatatctggccagacagtcagtgctggtttcccaggcccatatatgtactgttcacagtttctgtggttttgtcatcaaaaattatttccaccgcatcggcctggatccggcgtaccgccagggcaacgaagcggaactgaaaatgttgaaaaaggatgtgctggaagatcttctggaagaggaatatgaaaaggaacagccggattttatggaactggcgtctatggatctttttaataaaaacgatcaggggctggaggatatgatccttgcggtgtatgacagtgccatgagcgagccttttccgaaggactggctgaaaaaagcggaggatcttctgcaggtggagacagaggaacagtggaatgatcacccggtggtgcagtgggttttgacaaattgccgttatatggcggaggcactggatcaggaggtggattctctgttggatctgtgtgatgagcccgggggaccttatatgtaccgcccgtgtatggaaggactgaaagacattctttcttctctgatgcaggcccggacctgcggagaatggcaggatgtggtggaaggaatttcctttggaagactttcttctaaaaaagatgaggatgtgtcgggggaagccagagagtgggtcaagaaaaggtacgacgcctgtaagaaaaagatccagtcttatgcccagatgtttttctttcagccggaaccggagcacagagcggacttaaagcagactggagggaagatcagcggtctgcttcgccttaccagagaatttatggaacgttatggtgagacaaaaagagaccggggaatcatggactatgatgatctggagcagtttgccctgaagatcctgctgcggtgggatgaagagaagcaggtctatgtgaggaccgaggcagccggagaactggcagaatactttgaagaggtcatgatcgatgaataccaggacagtaaccgggtacaggaaacccttcttaccagcatttccagacaggggttagcatcctatgcgtccaatctgtttatggtaggagatgtgaaacaaagtatttaccggttccgaaatgcctgtccggaactgtttgtagaaaaaatggacgcttatcatggagaacaggcggcgggacaccggatagaccttcattataacttccgaagccgggatacggtgctgcaaagctgcaatcaggtctttgaagatgtgatgcatcgggacatcggaggcgtggagtatgatctggatgccaggctggtgccgggagcgtcttttaaaccaccggaaaaagggcgttttgccggaaagactaaagtgatgctgggactgaccgggaccaaagaaggagtggcactgaagagagaagatgaagggtatctggcacttcgatatattcaggatataatgaatccccaggatcctatgcaggtcattgacaaagaaaacagctacagaccggcagagtaccgggatatcgtgattcttatgcgaagtatccgaaaagacggacagaaggtatatgatatattgacggaacatgggattccggtagtaatggaacatgaccagggattttttgacaccagagagatacagattctgtaccagatgatgcaggtcattgacaatccactggtggatatgccgttggcaggggttctgatgagcccggcctttgactttacggaggaagaaatggcaaaaatccgcctccggcacaaagactgcggcttttatgatgcaatgaggcagtacgatgaggcggatggggtatatgagcatatccagcagtttctggatgtgctgtccagactccggagcaaggttacctatgcttctaccgctgagatcctgcaggatatctacgatgaaaccgggatttatgacaagatccgcacgatgccccagggaatacagagggttgccaatatggattaccttatggaacaggcccgtgcttatgatgaggtgacttaccggggactgcaccagtttgtccgttatatagagcagttccgccggcagcaggaagatctgggagaagtaaatctgtttggccaggaagaaaatgccgtgcggatcatgaccattcataaaagcaagggactggagtttccggtctgcattctcatgggactggggaaaacattaaaagtgccggacagaaaggccgttcgtacggattccgagtttggcatcagtatccaggcagaagatccggagatttccaccataaaaaacacttttatgttccaggctatgggacataaaaaccagatggaaagtctgggagaggaattgaggattttgtatgtggccatgacccgtgccaaggagcagttgtgcatgaccggtatggtcagttctctggaggaaatggggctggattacaacagccgcagtgagatgaaccattattgcgacatggtgctgccggcggtgtaccgcagaggagatctctttgatctggaggtactggaatggcaggatctggtgctggaagaggccagccagcaaaaagaggtagacagagagaaagacaggctttataattttgacacaagtaaggtctacaatgtttccatgcatgagatattagaactgcgtaaaactgtcagggaagaaaaagaagtgctgccggtgaaagtatcggtgtccgaactgaaagaaaaatccatggaagaactggatatggaagagtttcacattctgtcagcccaggaggaaccggacgaagagccggtaccatcctttatgggaggcggaaaggaaaaaagagaaaatgccggtgctgcctatggaactgtctggcatcaggttatggcatttctggatttttctcatgtggcatcacgcagggagatacgagaatcgctggaacaggttgtacaggccggtcatgtgagaagagaggatctggctgtgatccaggtatcccgtctggagcagtttttccagtcggagcttggaaaacagatgtgtctggcttatgaggatggcagactgcaccgggagcagccttttgttaccagccgtccggcgaaggaagtgctggcggattcgggcagcgaggaagcggtgctgatccagggaatcatagatggatattattttacagaagatggcattgttttgatggattataaaacagaccggatccagcccggaaaggaacaggatctggcagaccgttaccggacccagatggcggtgtatcgtcaggcgttacaggacaacacgggccggccggtaataaaaaccgtattgtattctttttccctgggaaaagaagtagagttggaattttag

SEQ ID NO: 3073 - DNA, 978 bp, Clostridium sp.
atgtttggaaaattaattagtattttgaaggaaaatccaaagaagattgtttttacagaaggaacggatcctcgtattcttgaggcatcctctcgacttttggcaagtacctttctggcacctattctgatcggaaagaaagaagaagtagaaaaggtagcagaggaaagtggttttaatattcgtggagctgagatcattgatccggaatgttatgaagaaatggatgcaatggcagaggctttgtatgaaattcgtaaatctaaaggtatgacactggagcaggcaagagagacttgtctccaggccaattattttggaacaatgctggtaaaaatgggtaaagcggatgcgcttctgggaggcgctacttactcaacagccgacacagtacgtccggcacttcagatcatcaagacaaaaccgggtaaaaagatcgtagcatcctgctttattctggttcgtgagtcagctaccgatggaaatacagtactggcaatgggagactgtgccatcaacatcaagccgacagaagatgaactggctgagattgcagtaggatgtgcagaatgtgccaagatattcggtattgatccgaaggttggtttcctgagttattctacactgggatccggtaaaggtgaagatgtagataagatgcgtgaggcagcagcgaaagcaaagaaaatggcaccggaacttcctatcatcggtgaagttcagtttgatgcagccgtttctcctagagttgcccgcacaaaatgtccggacagcaatgtggcaggttctgtcaatacatttatcttccctgatattaatgcaggaaatattggatataagattgcccagagactgggacattttgatgcatacggtcctattatgcttggattgaatgcaccgatcaatgacctttcccgcggatgtaatgcacaggaagtatattccatggctattattaccgcagctttagcatag

SEQ ID NO: 3074 - DNA, 1974 bp, Clostridium sp.
gtgaggcagcaacagaatgaaagaaatggggattatattgtgaaagatggttttgtgaaggcagccgtatcgacaccggaactgcgtgtggcagactgcctttttaacgaaaaaaaaataaaagaaaaagcagaaaaactggcagaaaaaggtgccaggcttattgtgtttccagagtttgcactgacaggatatacctgtcaggatctttttttgcaagatacattgttagacggtgccacagaggcattaaagcagctggctgtggatacagccggtataaaagctgtggtcgtagtggggctgccactggagatgcagggacggctttataatgtggcggctgtactgaatcagggaaaaatccttggatttgtgccaaaaagccatatgccaaattatggagaattttatgaggccagacagtttgcgccgtggaagggtgagaacacaacataccgttttcaggatggcacagaagttccttttggtacaaagatcatttttgaaaacagagaaatgagagagtttacttttgccattgagttgtgcgaagatctgtgggtgccgcagcccccatcgggagaacatgccatggcgggagcacacctgatcgtaaatctctctgccagtgatgaactgaccggaaaggcgtcctaccggcgtgatctggtgaaaaaccagtcggccagaaccctcagcggctatctgtatgcggatgccggagaaggggaatctacgcaggatatggtctttggcggacacaatctgattgtggaaaacggaaccatattggaggaatgtcagccttttgctacggaacaggatctgataacagaactggatgtgaaacggctgaaaaatgaaagaagacggatgtctactttttccctggaaccaagagcggattatgagagagtatattttgatacgggagcctgtgagaaaacggttcttacaagaacttttgagaaaacaccttttgtcccatccggagaagcggccagacagaaacgatgcgaagaaattctggcgatccagtctatgggactggccaagagacttcggcatacagggtgcaaaaatgccgtgatcggtttgtcaggagggttagattctaccctggcacttttggtcaccgtaagggcttttgaccggctgggccttgaccgaaagggaatctggtgtgtgacgatgccgtgttttggcaccaccagccgcacctacgacaatgctgtatccttggcaaaagagttgggtgccatcctgaaggaaatccggatcgaggaagcggtacagattcatttccgggatatcggccatgatccacaggtgcaggatgttacctacgaaaacggacaggcaagagagcgtacccagattctgatggatgtagccaatcaggcaggaggcatggtgatcggaaccggcgacatgtctgaactggcgctgggctgggctacttacaacggggatcatatgtctatgtatggggtaaactgctccattccaaagacgctggtaagatatctggtgcgttattatgcggatatggcggaaaatgagaagttaaaaaaggtactttatgatgtgttggatacgccggtgagtccggaacttctgccgccaaaagaaggagagatcgcccagaaaacagaagatattgtgggaccttacgaacttcatgatttcttcctctactatgtgctcagatgcggttttacaccggagaaaatattcagactggcggtttatacatttgaaggagaatatgacaaagaaaccatctacaaatggctgtacacattctgccatcggtttttccgacagcagtttaagcgttcctgtctgccggacggaccgaaggtgggaaccgtatccgtgtcaccgagaggggatctgcggatgcccagtgatgccagtgatggtttgtggaaacagagcttagaccggattcgtcaaagcctggtttaa

SEQ ID NO: 3075 - DNA, 1602 bp, Clostridium sp.
gtgaaaaggaaagtgcggtttttagggggcatccttgctgcgatcatgtttgttacggcatgtcagaaaacccaggtagtagatgagagtgtcagtggactgaaagaagatgaggtggcactggtaaaatgcgatgagggaaatcccatggccggaaagtcagatacaggggattatatatatggaggagatccatcggtcctggtagacggagatacggtgtatgtatataccggacacgatatttcaaaggatgaccaggtggaacgaaaggtttacaacataccggaatatctttgttattcttcaaaagacctgaagacttggaaggcagaaggcagcgtgatgaaggtaaataaaaaaacagtggactggaccagcagcaatatgtcagcctgggcttcccaggtggcaaaacactatgacaagaaggcaggaaaagaccggtattatttatattattgtacctgggacgctaccagccagggaaaacagtccattggcgtggcagtggcagacaaaccaacaggcccgtttgaagacatcggaaaacctctggtacagggaaccaccaccgtatcccagaacagcaactgggatgacattgatcctaccgtatgggtagaaacgggcaaggacggagaggaacaccggtatcttggctggggcaacagccgtttttttacctgtgaactgaacgaagatatgatctcggtaaaagacttaaatggagatggcaagatcacttacgccaccagcatagaaaaaggagacattctgccaagggaagtcagcggttttaccgaggcgccatggttttaccgcagacagaatgaaaaaggagaatatgtaggtccatactatctgttttatgccagtggatggcgggaaaagatggcttactccacaacggatgatcttatgacgggaacctatacatggggtgagagcattatgtacccaacggccacatccaataccaatcacgaggctgtgtttgattttaaaggcaaaacttattttgtatatcacaatggttccctgcccggtggaaacggataccgccgcagtgcctgcatccgggaactgaaatttggcaaagatggatccgtggaagagatggaagagactgccataggactgaccggtacaacctatgtgatacgagacggagaaaaacaggaactggcccatgctccgtttaacaattcatccagtgatactttgtatccgtataagaggattaagatcagtacgctgtttaccacaggaaaagaggttgacaaaaaatgggtattccgttcaggaaaagccgatgcgaaaaatgctgcttatgtgtccatagaggcagaaaataagccgggactttatattacagccaatgcagacggcagcgtcacactggcccaggatgcggatgcatcggaacagacggccaaaaaccagacattcagaaccgtaaaaggtctgaaaacttccagggggacatcttttgaaagtgtggcatatccgggaaaatatctggtgttaaaagatggcatgctgaaactcggaacaaaggaagacaaagaggaagcaactttctatatcgataaaaagtaa

SEQ ID NO: 3076 - DNA, 2364 bp, Subdoligranulum sp.
atgagtagcctgtccagaaaaaaattcggggaagggtatctgttcacattcctcgtgtgcattgtcaccgctgctgttttgtatacgccgttccttattattgacaagggcctgttccaatactgcggcgatttcaacagccagcaaatccccttctatacctatatgaacggctttgtgaaaacggccggcggccagtggagctggaacacagaccttggcacttccgccatcaacgggtattcgttctacctgctgggctcgccctttttctggctgagcaccctgttgccgcaaagcgccgtgccctatgccatggtgccgctgctggtgctgaagtttggcgtgtgcggccttgcagcatacacctatctgtaccgctatgccaaaacgcggcaggcggcggtgattgccagcgtgctgtatgcgttttccggctttacggtgtacaacacattttttaaccattttctggactgcatcgccctgttcccactgctgctgtgggcgctggacgaggccgtgctggaaaaccgcaaggctcttttgccggtgcttttggcggtaaaccttgtgaacaactatttcttttttgccgggcaggcggtgttcctcatcatctattttgtgtggaaggcggtgcggggcgaataccgcctgcgcacggggctgtttttccgccttgccttcgagacggtgctgggctgcgccatggggtgtgtgctgctggtgccggcagtgagcttccttttgggcaacccgcgcacggtggacccgtccagcggcttcggttttttgatttacagcaaaccgcagcaatatttcgccattctcacttcgctgttcctgccgccagacccaacctacctgcccaatatctttaccgactgcatcatcaagcacaccagcatgacggcctacctgcctgtggtgggtgcggcgggcgtgtttgcctacatgggcgcgcgcaagcgcagcgccaacacggccattttgtggacatgccttgtaatggcgctggtgccggtgctgaattccagcttttatgcgctgaactccagctattatgcccgctggtattatatgcccatcctcatcatgtgcgcggccaccatgcatgcgctggaggatgcggacatcgacctgatgcacggcatccggccggtggcggtgattacggcagtgtatttggtgttcattctggtgcccaaggaagaggacggcgtgtggagccttggcgtggtgcagcagcccgcgcagttctggcttatctggcttacggcggtgcttggcgtgctgctgtttttcggcattgtcaaatatttccgtttcaccacaaaattctatgccgcgctgctggccgccattttgccgttcagcgtgttttattccgtgtgccatatcggcatgggcaagttcccccagtgggagaacgacgccgattaccgcaggcagatgttcgaggctgcgcccagcattgcgtggccggaggacgatttctaccgggtggattcctacgagtgccaggacaacctcagcctgatgatggaaaagccgtgcctgcagttttttaacagtacggtcacgccctctattatggaattttacccgctggtgggggtaaagcgcgatgtctcttcgaagccggagcaaaacctgtatgccctgcgcgggctgctgggagtgcgctatattatgatgccgctggaccaaacggccgcctttgaagaggaatgcggccagtggggttacacctgggcgtttgcagacgatacgtttgccttttaccgcaacgaaaacgccctgcccatgggctttgcctacgacgcctacgtcaccatggaggaactggaagaggtggaagagacaaagcgcagcaacgtgctggtgcgcgctgtagccctgacggacgagcaggtggaaaaatacggcgggatgctgcgccatttgaccgacgcagagcgcacaggaaactcttacgagcaatatgtgcaggatgccgccgcccgccgcgccatgggcgtgacagatttccaggcggacgcctcgggcttttcggccaatatccagctggaaaacagcacgctggtgtttttcagcgtgccgtgggacgagggctggacggccacggtgaacggccagcccgtgcaggtggaaaatgtcagcggcggcctgtgcgcggtggtgtgcccggcagggcaaagcaccgtgcagttccactaccagacgcccggctttgcgctgggcaaggccatcagcctctctgcgtgcggcgtgtgggccgtatacgcgggcacggcggtgttcttctggcacaaacggaaaaaggagaaacagcaatggcagaacattctgaaaccataa

SEQ ID NO: 3077 - DNA, 5976 bp, Subdoligranulum sp.
caggcctccagccagtatctgctggcagatttgggcgacgatctcgtcattgaacgcgacccctcgtcagacccaaacaaccccacttcgggcaccatgaaaattggcaacgcctggaaatataacctggacggcacacaaatcacctatagcatccgcgaggccgagggccagcagacggggcaggtgacaattccctcgctgcagaatggggattactttgccatttcttacgataacgcttcggcgccaaacttcggctctgtaaccgacaggctgtacagcggcggcaccttgtatctgacgctgacaggccgcaaaacgtatgacgcacacaaggtgtggctggacgaaggcgtggctgccggtgcgcaaagccagcgccccacgggcgagtttcagctgtggcgttaccgcaagggccagcccagcaccaccgctgcgccggtgcgcagggcggacggcgctattgtcaccctgccgttggataccggggttgacgaacaggaacttttgttcgacgcactggaaaaatatgacgcagagggctatgaatacctgtatgtggtgcgcgaatatctggacagcaccacgctggacggggcgcctgcccgcagttatgaacaggtgtttggcaaggtggatgccgcaaccggcagcatcaccgacagaattgaacaggacggcgagctggtggacatcaccaccccgaacgtgcgcccggccggcaacacgtttttgtacaatgggggcactttgtccaaccgcatcacagacgcggtagaagccgcagccaccaaggtgtggaaggccagcgctttccagtcggaatttgaggacgtggtggtagagctgacgctgcaaagccgcgtaaaaggccagcccggggcccagtggcaggccaccggcgtgacacagcgcatggagcaattttttgcagagaacctttccgcctcggtgcgccgcaccatgccccggtatgacgccagcgggcaagagctggaataccgctgggtggaaagcgccgtataccagggcgcgggctcggaagaaaacctgtttgccccggacggaaccggcgggggcacatttacccttgcacagggcggccgcaccgtgcagtaccgctcggccatccggcaggcgggcagcgcgggcaaggggtattccaccacggtgacaaacaccattgccaacaccattcaatacgaagtggcaaaggtgtggctggatgaaaacggggaaacacagcccccgcagggggccacggccacatttgccatttaccgcatgcgaaacggcgaagcactgggcgagccggtggcggttttttccgtggacggcacggcagacgcagagcccacggtggtgaacaaggcgctgggcatcttggcacaggagacagcgccctggcaggcaacggtgacgccgctggacgagtttgacgagaacggcggacaatatcagtatctgctgctggaacagggcggcacggccaatttcattcctacttacaaaacagagcgcgacgaacagggctaccacaccacagtgtacaacggcccgggcgagggcaaccgcattatggtgcggaaaggctgggtggacgacagcgatatctcgcaccgcgaggccgttaccgtggccgtgtacgaccgcgccaccaacgaaaaggtgaacgaagttaccctgggcggcggtgtgtggtatgcctgggtgggcattggccagcgcgcaccggaggacgtctatattctggaaactcaggtgggcggcacaccagtgccgcttacggaagaccctgcaaatttcacacagccgcaggcgccagaggaatatgacggcccgggagacgatacttatacggccatcccctatgaaaccgattatcaccgttacgaggttacctacagccatgaagtgctgcagggcgtcaccttttatacggcggccaaccgccgctttggcaatatcgatttcacagccaccaagacatggcaggacggaacgggcgagctgcgtgcgcaaattgcacagcaggccgaagaaagcggatattcccttgtaatgcagctggaatttgcccggcaggacgtgccggcgtattatgccatcagccgcggccgggcgggcggcgacgccgtggcaattggcagcccggcagaccaggtgcccattgcagacagcacgggggcccctgtggcatcccgccagaagctggactttacccaaaaagaaagcacctatgaatttttcgaactgcccaaatacgaccgcaccggcgccgcggtgcagtacaccgtgcgcgaggtgtggctgaatgcagacggcgaagaagtggaggtgtctcagcttcccgaaggcctgcagaaccttttggccgattaccgcaccgcttatggagagccgcagtatgaggcaagcgggcaccgcgaggcagacaaacagttccagcaggtgacaaacagcctcagcggcacaaaaacggccgtctggaacaaaatttggaaagatgacgccatatatgaggcgggccaacggccagacatctatttggacatttatcaggtgcggcacgatgaaaacggaaacccgcaggcgtcgctgcgccaggcaaattacaaatggacgtatttggacgaagagggcaccagcctggccgaatattgggtggcggaattgagcggcctgcccaagtatgacgaatatgggtatgagattatctattatgccgtagagcacaccaccgtggacgcgcagagctttgattacctgcccgttgcatacggcatgggtgagcgcggcagcctgcgggacattggcacagcgctggaattgaacgaagatgtacagcagggcgacacgctggacctcgccctggtttccggcgcaggcaatgatgccgcggcgaagtatgctttgcgtgaaacgggcacctttaccaatgccatttatcaaaccgtcaccgtacagggccagaaattgtgggcgtccctgcccgcgggctacccccgcgtagaccttcccaatgtggagtttggcctgtaccgccgtttggcacagcaaagcgaggccgaggccgtgcaggtggcctcgctgaaggtggaggaatgggccagcgtataccagaacggctcataccggttccgcatggaatatgaaggcggaaatattatgacggcagagaacggcgccatcaccatttcgcccgaacagccgggtgcggcccggctgccccaatatgacgcggaaggcaggctgtacctctataccctgaaggaaaacagcgtcacctggccaaacggcaccacacagccggaaagcggccttgtctatgccgaccccgtcatcaacacctaccttgtggaaaacaaatatgaaagcgtgaagggcgccacggcggtaaagaaatttctggagctgcccatggacgcaagcggccagccggaggcattcccagccatcacctttgtgctgacgcgcacctaccgggcgcaggacggcaccacatctgcgtcagagaccgtgcagcgcctgacgtggagctcggccgaggtgcaagcggcctaccaggcggcacaaaataaaacggccccgctggaagtgaccctgcggtttgaaaatttggatatctatgcgcccaacggcgaagcgtaccaatacgccatctcggaagacaaacaggccctgggcggctatgacacatggggcatgcccggggacggcacgccggagattctgcgcggccagcccggctatgcggggcaaacttctgtggaaaaagtgcgcattaccctgaatgagggcaacggccgcgggcagacggcagacgaagtgtatgtgggggccaccttcctgaacgccccgcagccggcgcgcgagactgtggcgctttccggcacaaaacaatggcgcgattacagcaaccagttcggcctgcgccccggggacgtcacgcttaccgtaagccgctatgccgacgcccagcccggccagggcaacgccattgccaaagaggaaatgcctgcgggcagctatgcagtggtgtgggacgaagcaagcaaggcaggggatacctggcgctattctgtcacaggcgcacgggccggtgagctggagcgctatgcccccaacggcatgccgtggcgctatgaggtgacagaaaccctgcctgctggcagcgaatacaccatgtcgccggcaaacggcacggtgggcgaacaaagccgcagcgaggcgggcggcgccctttccgtcaccatgcgcccgcttacaaacaccatccttaccagcgcaccttacagcaaaggctgggtggacagcgcaggcggcatcatcaccgaagattaccttggctttgatttggccgtcaccttccagctgcaagtgatagaggccgacggcaagggcggccaaccggccagcggggcaaagtgggccgatgcgggcacctattttgaaaaggcgctttctccgcaggcctatcaggcactttttggcagctattcctttacccaaacccaaacgggccgcatcaacgacagcgcggtgtggggcaaaacgtattccttcgcaaacctgccgtccgtcatttcaaacagcacgggcgggcttacctacctgcgctaccgtgtggtagaggccggcattgcatacaacggggcggttcaaaccgtcacggtggtaaacgaagatgaggccgcgggcacttaccagtatgagttcagccccggtttgttcagcccggcctattgggcaaacgggaaaaaccagccggaaacggaatacaacctgttcaaaacgcaggcgctgtataaccggcttgaaaccacagagttttcggtggcaaagcaatgggtgggcgacggcggcaacgcctacggcacccggcccgaaacggggcgcaccggctttgactgggaggcaagctttgtcatccagcgctcggcagatggcggggccagctgggagaatgtgaccgtgtaccaaaacggggcggagcaagacctcaccctgacgctgtatggcacaaaccggcaaagctatgccagcgcggccgttgcgggccttccccaggcggacgagagcggccgccagtatgcctaccgcgtgcgcgagctgcaaaccggctggcagcagcgggaacaggccggccgggtgaatgcggccgacattctggacgccaatgccatttacaacaccgcctatacggcggcgtatgacgatgccgcccaaatcgtctctaacacgctgcggcccacccgcatctatgccgaaaagcagtggaatccctcggctgcgccggtgcctgtcacctttgcgctggaatatctggccgaagggggcgcctggacgaagctggcgcaggtgacggtgtacggcacagccgacacgcagccgcaggcaccctattatgagtacaaggcgtggaatgccgtctgggaaaacctgccgcaggccatgccgggcagcagccttgcccagggcggcaaaacacagtaccgcgtaacagaaacactgcccggcggctaccttcagcaggcaagcgagcaggcaaccatagaaacgggcggcacagagtaccccctgttccgctatgtcaatgtggaagccacccgcctggcggtggaaaaggtgtggcacggcaccccgcaggcccagcagggcgatgtggtggtgggcctgtggcgcaccaccggcacgccgggcgatgccgcttcggaagaggtggcgggcgccggcgggcagcaaacccttgtgctcaccagggcaaaccactggcagggcagctttgcaaacctgcccaaatatgacgcggcaggccaggcatacacttattatgcgcgcgaactctctgtgggcggccgccctgtgaaggacccggatttttgctttgccgtgcactacgaggatgcacagggcaaaactacggtgacgaacacctggctgcaggagcttagcggcaccaaaacctgg

SEQ ID NO: 3078 - DNA, 2571 bp, Subdoligranulum sp.
atgcaaaaacaaaagtatgacgtgacaggcatgacgtgttctgcctgctcggcccatgtggaaaaggctgtgcgcaaggtgcagggcgtgcaaaatgtcacggtaaaccttctgacaaacagcatggtggtggaggcggacgattccctttccccacaggctgttacagcagcggtggaaaaggcgggctatggcgccagccctgcggggcagggcgcggccgcgcaggcacagcctgcacaaaagaaagaaaaccctgccgcacagcagatggcagacatgaaaaagcggctggttgtctcctttgcgtttcttgtgccgctgatgtatatttccatgggaagcatggcaggcctgccgctgccggcctttctcaccggcattgaaaacggcgttgccttcggcatggtgcagtttttgttggcgctgcccattgcctatgtgaaccgaaaatattatcaggtgggctttaaaacgctgttccacctaagccccaatatggacagcctgattgccattggatctacggcggcctttgcatacggtatttttgccattatgcgcattgggtatggcctgggcgtagacaacctggcgctggcgcaccagtatcatatggacttgtatttcgagtctgccgccatgattttggcacttattacgctgggcaaatacctggaggccaaaagcaaagggaaaaccagcgaagccattgaaaagctgattggccttgcccctaaaacagctacggtggtgcgcggcggtgaagagcataccgtgccggtggaacaggtgcaggcaggggatatcattgcggtgaaaccgggccaaagcatcccggtggacggcgtggtgacagagggcaccaccagcgtggacgaggccgccatcacgggcgagagcatcccggtggaaaagagccccggcagcacagtgctttcggccagcatcaacaccaccggttcgttccggttccgtgcaaccaaggtggggcaggacaccacgctttcccaaattatccgcctggtggaagaggcaagcgccagcaaggcgcccattgccaaactggccgataaaatagccggggtgtttgtgcctgtggtaattgccattgcgcttgtggccacccttgtgtggttggctgtggggcagacggcagaatttgcaatttccattggcattgcagtgctggtggtgtcgtgcccgtgcgcactgggccttgccacaccggtggcgattatggtgggcactggcaagggcgccgaaaacggcattcttatcaaatctggcgaggcgctggaaacagcccattcagtgaacgccgtggtgctggataaaaccggcacccttacaaacggtatgccggtggtgacagaccttctgcctgcgcaggggtttgatgaaacggctttgctgcatttggcggccagcctggaaaagcccagcgaacatccgctggccggggccgtgctggcccatgccaaagagaagggcgtgcagcccgcgcagctagagggctttgcggcggtgtttggcaagggcgtgcaggccaggctggccggcaaggcctgcctggcgggtaacgcggccctgctggccgaggccggtgtggaattgcccggggaatggcagcagaccataaacgccttgtcggaagacggaaaaacgccgctgctgtttgcccaaaacggcacgtttgccggcgttgtggccgtggcggataccctgaaagaaaccagcatagaggctgtgcgcgaactgcaggatatgggcattgaggtgacgatgttgacgggcgataatgcccgcacagctgccgccattcagaaaaagctgggcattgcccatgtggttgcccaggtgctgccgcaggacaaagcgcgccatgtggcggccttgcgcagccagggcaaggtggtggccatggtgggcgacggcgtgaacgatgcgcctgccctggcgggcgccgacgttggcgtggccattggcgcaggcacagacgttgccattgaaagtgcagacgtggtgctgatgaaaaacgatttgcgcgatgtgcctgccgctatccgcctttccaaagcggtcatccgcaacatcagggaaaatttgttctgggcattcttttataacacactgggcattccgcttgccgcgggcgtgttctacagcgcgctgggctggaagctgagccccatgttcggcgcggcggccatgagcctttccagcgtgtttgtggtttccaacgcgctgcgcctgaaacgctttgacgcttataaagccaaacgacggccgggcggggcctccgctgcggcggcacaaccccatctggccgatgaaacacagaaaaaaacggaggaaaaagctatgaaaaccattacgttatcaatcgacggtatgatgtgccagcactgtgtggcccatgtgacgaaagcgctgagcgccatagagggcgtgacgccggtggtgaacctggaaaagaaaaacgcggtttgcaccgtggcgggcgatgtgccggcagaagccctgaaagccgcagtggaagaggccggttatacggttacggctgtggag

SEQ ID NO: 3079 - DNA, 2520 bp, Subdoligranulum sp.
ttgaaattacttgtactggacggcaacagcattgtgaaccgcgccttttatggcatcaaggtgctcaccacaaaagacggccgttataccaacgcccttgtgggctttatgaatatccttttgaagctggaaaatgatgtgcagccggatgaagttgccattgcctttgacctgaaggcgcccaccttccgccacaaaatgtacgacggctacaaggcgcagcgcaagggcatgccgcaggaactggcagaccagatgcccgtgcttaagcagcttttggcagaccttggctaccgcatggtgacgtgcgagggctatgaggcggacgatattctgggcacgctttcggcggcgtgcgaagcgcgcggtgacgactgcctcatcgccaccggggaccgcgacagcctgcagctggtggggccgcacaccacagtgctgctggccggcacctcgctgggcaaaagcgtcaccgtagagatggacgaagccgctgtgcaggaaaaatacggcgtgacgccgcgccagctgattgacgtgaaaagcctgatgggcgacgcctcggacaacattcccggcgtggcaggcgtgggggaaaaaactgccctggcgctgattgggcagtttaaaaccctggagggcgtatacgaacatctggacgacgccggcatccgccaaagcgtgcgtgaaaaactgatccgcggcaaagagcaggcacagctaagccgcaggctggccgagatatgccgcaccgcccctgtgcccacgcagcgcggggcttatgaaaaagacgcgcccgatgcggccgccgccacagaccttttgaacagtctggaaatgtttgccacactggaaaagctgacgctggacgcccctgccgtgccccagcaacctctgcccattgcagaggccgcccctctgcccgcggcgctgggcgccgcacgcgtggacatctgcatggcgggcgatgttgttcttattgttgacagcggcagtgtttatacttccagtatagattctgcagaatttctggagcttttatgcagcgaggcctgcgaaaagcgctgttttgatgcaaagccgctgctgcgcgccgcgctggaagccgggcgcgagggcaaagccgttatatttgacgcaaagttggccgcctatctgctgaacccggccgccagcggctacgacgtgcagcacctggcggcccagtatggcgtgcgcccggctttcagctgcgaatatgccgaggcgggcgtgctgggcggcttgttcgacaagctggcgcaggcctgccgcgaggaagggctggaaagccttctgcacgacatcgagctgccgctgtccgcagtgctggccgatatggaataccgcggcatcctggtggataaggccggcattgaggcgtttggcaaagagctgagcgccgcgctggatacagaactggccgccatctaccaggccgttggctatgagttcaatgtaaacagccccaagcagctgggcaaggccctgtttgaagaccttggcctgcccacgcgcaaaaagacgaaaagcggctattccaccaatgccgaaacgctggaaagcctgcgggaatacagccctgtcattgaccacattcttttgtaccgaacctaccaaaagctgaattccacctatgtggaggggcttttaaaggtaattggcccggacgggcgcatccattccaccttcaaccagacagagacgcgcacagggcgcatctcttccaacgagcccaatttgcagaacattccggtgcgcaccgagctgggcagccggttccgcaaatacttcatagccccccggggcagcgtgctgctggacgccgattacagccagattgagctgcgcgtgctggcccacctctctggtgacgaggcgctgcagcaggccttcctgcatggggcggacattcaccgcaccaccgcggccaaaatgtacggcgtgccaaacgagatggtaacagggcagatgcgctcttccgcaaaggccatcaatttcggcatcatgtacggcaagggcgctttcagccttggcaaagatcttggcatctctgttaaggaggcccaggaattcatcgatgcctatctgggcgcctacccgaaggtaaaggcctttatggaaaaaaccattgccggcgggcgcgcaaacggctatgtctccaccctgtacggccgccgccggccgttgccggaactgaacgccgccaatttcaacattcgctcgcagggcgaacggatggccatgaacacccccattcagggcacggcggcagacgtcatcaagcttgccatggtgcgcgtataccgccgccttgcggcagagggcatgcgcgcaaagctcatcctgcaggtgcacgatgaactgattgtggaatgccccgaggaagagaaagaaaaggctgccgccatcttaggcgaggaaatgcgcggcgcagccagcttttctgttccgctttcggcggatgtgaactgcgggcaaacgtggtatgaggcaaaaggctga

SEQ ID NO: 3080 - DNA, 4521 bp, Subdoligranulum sp.
atggccctgtggctggccctggcgctggcggcttccatgctgccggcgggctttgccgcgggcgaaagttcgtcctcctcgggttcgggcccggcccaaagcgcggaagaggcagatgacacaaaccttccctatgaatatgaattggacgaggacggcaacgccacgctgacgaaatataccggcagcgaggcggaagtggtgacgcccaaaaccattgacgggcacccggtcacacgcctggagggcactttccagcagcccgaggaagaagaggccggcgcgccggcaagcgcctcttctgccggggaagaaaaggcgcaggccacagagcaaaacgaagctgccggcatccgcagcatcacggtgtcggaaggcgtagaatacatggatggctacacctttgcaaacctttccaccctggaaaaggtttcgcttccctctaccctgaagcaggtgaacggctacacgtttgagggcctggaaaatttaaaagaagttgcgctttcggaagggcttgaaaccattcagacagaagcctttcggaacaccggcattgaaacgattgtgcttcccgaaacgctgcagaccattggggcaaaggcgtttgaaagcgaggccttgaaagagattaccgtgccggccagcgtcacccgcattggcgggcaggcgttccgcaccgatacagaactgaccatttacaccaccatgaactctacggcggctgtgtatgcgcagctgaaccagattgatgttgtgtacaccgactatgtggccgtggaggaagtgacgctggataaaaccgagctgacgctggtggagggcgagacaggcctgatgaaggccgatgtgctgccagaggacgccactgaaaaaaccgtgacgtgggaatcttccgaccccgctgtggccacggtggatgaaaacggcaccattacggccgtgaaagagggccaggttgccatcaccgccaaagcgggccaggcaagcgcgtcgtgcacggtgaccgtgaaccccattgacgacagcgtgaccgtgggctggacgcaggacggccttcactatgtgcgcgcggacggcagctatatgaagggccttgctgaaatagacggccaatattatattttcagcgaggatgacggcaccctgcaaaaaggggaaaatgtgccctatggcggctacacctatggcacagatgacaagggcattttgatttcggtaacagtgccggacggggtgacggagctgccccgcggcgaatttaccattccctcgctgaaaacgttcaccatccctgccagcgtcacctacatgggggcgggctgcatcccggtggcagagggtgtggcagtgcgcgcgccgtacggctctaccgcgcatgtatacgcacagttgaataaccttagtttcgcctatacggatacggtgaccgtcactttggaccaaaccgagctggagctggtgaaagggcgcgaaaaaacgctgaccgcctctgtttcgcctgcgtttgcacaagagttcgagcaggtgtgggccagctcgaacccggatgttgccaccgtggaaaacggcgtggtgaagggcctggagctgggcgaggcagacatcacattagaggtggacggcgtgaaggccgtgtgccatgtgacggtgaaggacaaagtgtgcgacgcccattgggagggcgaacagtatattcaggaagacggcgagcccgccagaggcattgtggaaattgagggcaaaagctatctgttccgcgaagaggacggcgccgtgcagaaaaacgcggaaaatttcgcgtatggcgattatgaatacagcacagatgaagcgggcgtcattgtgggcgtgcgcgtgccggagggcgtcacctctgtgccgggaaaacagtttttcagcctgaaacagctgcaaacggcagatgtgggaagccacgtcacctacctgggcgcagactttgtggacgcggcctgcggggttgttatttatacctcacagggaagcctggctgccgtatatgccaaaatgcgaaatatccctgtgcgctattctgacggcgatgtgccgctggagagcatctccctttccgagacgcagctgctgctgcgcccgcaggaggcagcttccctgcaggtgtcttacgagccctgggacgcaacagaccgcgccgtcacctggagctcttccgaccccgctgtggccacggtggatgaaaccggccttgtgacggcgctggcaaacggaacggccgttatcaccgcgcaggtgggcggcaaaaccgcaagctgtacggtggatgtggccgaccgcaacacctgggtggaacagggcggtgacacctattacataggcgaagacggccagtttgtcaccggctaccaggaaattgaggaaaaattctatatcttcgatgaagaggggcgcctgcagaagggcaccatcacctatgagggccagcgcttcctggccggcgaagacggcgcgctgtatgtgcaggccttcgtggagggcgaagacggcgtcacctattacggcgaagacggcgccgcggtagtgggatggtttgaaacggcgcaggatgcggaaaaccaccccgcgggccgctattatcaggatgaccagacttaccttctggccgtgggccttgtgccgctgggcgacacggtgtattattttgacgcctccggccgcctgcacacccaggcgggctatgtgacggtggacggccagcagtattacattacagcggacggcatctattctccgccgcccgtcatcacggacgtcaccgtcagctacaacagcaaaacaggcgaaaacaccgtgaaggtgacggccacttttggcgccgcaggcgcggcggaaaaggcatacagctttgacggcggcaaaacctggcaaagcgcggccagctatacgtttaaggtgacaaaagacaccaccctggcgaaagactcggtgcaggtgcgcgacgccgcacagcccgcgcaggtggaaaagtacggctacgagcttgcgctgaaggggcccgtcaccgggccgctgaagggcattgacgtgtcttcgcaccagggcaccatcgactggcaggcggtggccgattccggcgtccagtttgtcatcgtgcgcgccatgtgctggagcaatgcggccggcggctatgccatggattccaaatttgtcgagaacgtgaagggcgccaaggcggccggcctgatggtgggcgcctattggtacagcgatgcgttcaacggcagcgaggcgcgcgaagaagtgagcttcattgccaattccagcgagtggaaggccctgaaggacgcaggcatcaccctggatttgcccttctatatcgattatgaggacccgtggattctgaaaaataaccactctacttacgacagccgcacagacgccgtgcgctccggcatggtggcggtggaacagatgctgggcaccgccacaggtttctacgccagtgaaagctggatgaagacgcagtttgacggcgcgggcctgatgaatgagggctataacgcctgggtggcgcactggggctcgtctcagggcatgggcaatgtgcagatgtggcagtattccaatgcgggcagcgtgcccggcatcagcaccaatgtagacctgaactggctgtaccccagcggcgcagggggcagcggctccagcgacggcacgggttccagcagcggcaacatcacggtgtgggacgtgaacacgagcaaaagcgtcacggccaacaccaccgaaattttgaaaaagattgtggccaacgaggtgggcggattcaccagtgcccagctcagcgcgggcgacaggcgcagcctgtaccaggcgcaggccgtggcggcgcactcctggcttatctaccagattcgccatggggtatctacgcccagcgtggggcttgccagcagctacagcagcgagatatcaagcgcggtagagagcgtgaaggacgtgctggtaaagtataacggcgatgtggccaacacggcctatggcagctgtgcggcggaaaaaaccaattcggctgccaacatggggtggggcaattatgcctacctggtcagtgtggacagcgcgttcgagcagaagtttgccccctcccagtattaccccagggctaccaccatcaagcaggagacaatgcgcagcaatgtcatcaaaatggtgggcgaaacagtgttcaaggcctatgaatcgaggccggaaagctggattaccgaaattcatacagacgccaacggctatgtggattacgccgtggtgtgcggccagcgcattaccggcggcaggttctacgagaactgctggggcatgtatggcgccaacctcgtcagctggagctataacagcgcagaccggtcttgggttattaccaccaacggcaacggccatggcgtgggcatgagccagtacggcgcggcgggctatattgcgcagtatggctggagctatacgcaggtgctgcagcactacttcccgggcgccagcgttgtgtaa

SEQ ID NO: 3081 - DNA, 2049 bp, Subdoligranulum sp.
atgaacgctttgacggcttttctggaatgccttgccacgttcttcgccgtgtgtgtgttaagcgtgtttgcggcaaaaaagtggaaggtgcctgcgggcgccgcgccctttgccgtgctgtgcggcacggtgctgtggtattcggccatggcctgcatcaaccagctgatgcctgcgggcattttgtggttcggcatggccatcgcggcgctgtgctggctttggctgcgccgcaggcagctgaatttccgggcgtttgtcaccccggccactgtgttttttgtggtggcgggcgtggctgtgattgccctgctggcggtgcgccagcccgtgttcacccagtgggacgaattcagcttctggggcctggcgcccaaggtggtaaaaagcaccggccagctttacacctataaccccggcgaaatgcgcgtaaccacctatgtgcccggccttattatgctggacgaggcgtttcagtttctgggcacacagtttgtgcagtggaaggtgtttgcggcatacgacattctgatgtttgccgtgtttgcggccgggctctctgtgctggagcgcaagcactggcacattgccgtgcccacggcggccgtaatgtgcctgctgccgtttttgatgacgatgtacttccgcgagattaacatggtgacggtgtacatcagcgcctatgcagatttgcccatgggccttttgttcggcgcgccgctggcgctgtatttttcgcaggaggaaaagacgcccgccattttgtggacgtgtgtgatgggcgtggcctttgtaagcattaccaaagacacaggctttgccctggcccttgtggcggcggccattctgtgctttgaccttatttttgtgcaggccaaaaacagcgtgcgccttacaggacgggtgggcggcctggccgcgaaatggacgtattcggcctgcctgatgctggccccgcttgccacctattttggctgggctcagcacatggccatgacgctgggcgtcagccgttcgaatttgggcggcgaccgaaacatgagcccggtgcagcttctggccaccgggctgggcgagctgtttggcatcaaccgcaccgagcgcttttcccgcgtgatgggcgagatgtggcaggcgttttactccacaaagctcaccatgttcaatgtgggcagccagcagggcggcgtgggccgcattgtcaacggctcgggcgccgtggtggtggcgcttattctggccattctgctgggggcttttctgctggaaaagggccgcaggcgccggggcattgcctggttttccctgtggagcacgctgggctttgccgcgtattatatcttcattggcttcacctatgtgtatgtgttctcggaagccgccgaaatgacggattacaaccgctatatctacccctactacacgggctggctgctggcggcgcttgccatttttgcggccgcattgcggcgcgcaaagcccggcgcgctgatgcactgggcgctgctggcgctgacggcggtgtgcgcctggcgcgtggccacctttgtgcccgcagagctgacggtgctgaacgatttgacgggcgcactttccgagcgcacgaagaacaccgaaagcgtagagcaggccaaggccctgcttactgaagaggacagggtgttctatattgccatgccggacaacggcatcagctggtttgtggacagcttcgatttctaccccgaggtgcatgtggattacagctttggcggcgggaactggatggataccacccttacgcgcagcattgacctgccggccaattttacagacgggcaggtggagtatttcctctcgcacgcgctgacgccggagaccgtgtgcgagtacatcgaccagacgggctgcacggccattttcatccgcaagctggacggcgcgtttaaagagcaatacggccatctgttctcggacggcctggagggcgactggcagctgtaccgcattgtcaaggatgagagcggcatgacctttgtgcctgtgccggaagggggcaagatcgtatga

SEQ ID NO: 3082 - DNA, 2997 bp, Subdoligranulum sp.
ttgcgttttcacgacaggcctcgccatcaaaccggcgcagggcagtgcgcccgaaagccggggcaggccttctcagtttttgaaggagagaactttttgtatcacatcggtctcgacattggcagcaccaccatcaaatgcgtggtgctggatgaacagcagaacctgctgtaccatacttatgagcgtcactattcccacattgtggaaaaggccgccgaggtgctggcccaggcggatgaggcattcgtgaaaggggctgcggcacgccttgcgctgtccggctcggcgggcatgggctttgccgaaagctgcggcatcccctttgtgcaggaggtatatgccacccgcattgcggccaaccgctatatgcccggcacggatgttgtgattgagctgggcggcgaggacgcgaaaattctgtttctcacaaacggcaccgaggtgcgcatgaacggctcgtgcgcaggcggcacgggcgcgtttatcgaccagatggccacccttctgcacatgacgcccgccgagatgaacgaggcggccaaaacggcacaaaaaacctataccatcgccagccgctgcggcgtgtttgccaaaagtgacgtgcagccgctgttgaaccagggcgccagcaaaaatgacgtggcgctgagcattttcggcgccgtggtgaaccagaccatcgccggcctggcccaggggcggcccatccgcggcaaggtgctgtatttgggcggcccgctgacgtttttatccgagctgcgccgcagctttgacaaagcccttggcgcgcagggcacctgcccggaaaacagcctgtattatgtggcgctgggcgctgcgctgtatgcgcagggcgaggaaaagctggcggatgtgacggcccgtttgcgcgaatattccgcaacggcaaagtatgccttccatgcgccgctgtttaaaaaccggcgcgagtacgaagatttccgtgcccggcacgccctggcagatgtgccgcatattgaatatacgccggagtgcggcgacatccacattggcatcgacgcgggcagcaccacggtaaaggccgttgccattgacgagagggccaatatcgtatacaccagctacgagcccaactccggcaacccggtgcccatcatccgccgctttttgcaggagatttacgccagctgccccggcgcccgcgtggcaagcgccacggccaccggctatggcgaagagcttgtgaaaacggcgttcggtgctgatttcggcgtggtggagacggtggcgcactttgccgctgcgcgccattttatgcccgaggtggattttgtcattgacattggcgggcaggatatgaaatgcttcaaggcggaaaacggcgccatcagcgacattttcctgaacgaggcgtgttcttccggctgcggcagctttttgcagacatttgccgaggcgctgggctattctgtgccggaatttgcaaagctgggcctgtttgccgacaaaccggtggaccttggcagccgctgcacggtgtttatgaactccagcgtgaagcaggcccaaaaggacggcgcgtctattgaaaatatctcggcaggcctttccatcagcgtggtgaaaaacgcgctgtacaaagtgattcgtgcgggcagcccggacgagctgggccgcaacattgtggtgcagggcggcacattctacaacgaggccgtgctgcgcgcctttgagcaggagatgggcgtgaacgtcattcggccctccattgccgggctgatgggcgctttcggcgcggcgctgtacggccgcgcccatgcccgcaaagagagcacgctgctttcggctcaggcgctggagacattcacccagcaggccaaaagcgtgaagtgcgggctgtgcggcaaccactgccagctaacggtaaacaccttcccgggcgggcgccgttttatttccggcaaccgctgcgacaggcccatcacgcaccgcaccggcgatgacccgctgaacctgtatgcctacaagctttcgctgctggcgcagtacggcgagggcacaggcacgcgcggcattgtgggcatgcccatgtgcctcagcttttacgagctgttccccttctggcatacgctgttcacaaagctgggcttccgggtgcgccgcagcgcattttccacccgtgccacctatctggccgggcagggaaccatcccctccgacaccgtgtgctaccctgcaaagctggcgcacggccatgtgaaagaactggccgaaatgccagacatagacgctattttttacccctgcatgagctataactttgacgagggcctgggcgacaaccactataattgcccggtggtggcctattaccccgaggtgttggccgcaaactgccccgagctggagggcaaggcgtttatctatgattttgtgggcccgcacaaccgcagggcgttccccaaaaagatgacggctgtgctgcaaaaacactggccggacatcacgcttgctgaagtggaggccgcagcggccgcggcctatgacgaatatgcggcgcatatggccgctgtgcgcaaacgcggcgccgagattattgccgaggcccgcaaggcggggcggcgcatcatcgtgctggcaggccgcccctatcatgtggacccggagatcaaccacggcattgataagcttatctgctcgcacggggccgccgtggtgaccgaggacagcatttcgcaccttgtgcagaaatttgatacgcgcgttttgaaccagtggacctaccacgcccgcctgtacgctgcggcaaagtatattgcagaccagccggacatggaccttgtgcagctggtgagctttgggtgcggcgtagacgcgattaccaccgatgaaacgcgcgagattttgcagcgcgagggcaagctgtacacccaaatcaaaatcgacgagattacgaacttaggcactgtgaatatccgcctgcgcagcctgttcgccgcactggagcagtaa

SEQ ID NO: 3083 - DNA, 3489 bp, Subdoligranulum sp.
atggcaactgaacacaggcagtttacccatttgcatcttcacacagaatacagccttttagacggcgcgtgccgcatcgagccgctgatggaacgggtgaaagagctgggccagacggccgtagccatcacagaccacggcgtgatgtacggctgcgtcgatttttataaagccgccaaaaaggcgggcattaagcccatcattggctgcgaagtgtatgtggcctcgcgcacgcgtttcgacaaggtgaaccgcattgacggctcttaccaccttgtgcttttgtgcaaaaacgagacgggctataaaaacctcatcaaactggtgtctgccgggtttatcgacggtttctacaacaagccccgcattgaccatgccctgctggaggaacatcacgaggggcttatctgcctttctgcctgccttgcgggcgaaattccgcaggcgctgctggcgggcgactacgaaaaggcaaaggccactgcccaatattacgaagatttatttggcaagggcaattattatattgaaatacaagaccaccgcctgccggaacaacgccgggtgctgcccatgctggtgcagctttcacaggagacaggcatccccctggttgccacaaacgacgcccactacctgcgcaaagaagattcgcgcatgcagcatatcctcatctgcatccagacgaacaaaacggtaaacgacgacgatgtgctggaatttggcaccgatgagttctatgtaaaaagcacggacgagatgtatgcgctgttctcggcatggccggaggcatgcgaaaacaccaaccgaattgccgggcagtgcaatttcgattttgaatttggcgtgacaaaactgccctatttcaaggcgccggatggggaggacaaccgcagctattttattcgcctgtgcaaagagggcctgcaccgccgctatggccaggaagtgccggacgaggtgcgccagcggctggattatgaaataggcgttattgaccgcatggggtatatcaactattacctcattgtatacgatttcatcaactatgcgcggcagcggggcattccggtggggccaggccgcggctctggcgcgggaagccttgctgcatactgcattggcatcacagatattgaccccattcgttaccagctgctgttcgagcgctttttgaaccccgaacgcgtctctatgccggattttgatgtggatttctgttacgagcggcgcggtgaagtgattgattacgtcattcataaatacggggcagaccatgtggcacagattgtcacatttggcaccatggcagcgcgcgctgtaattcgcgacgtgggccgcgtgctggacatgccctatcagcaggtggacgccgtggcaaagctggtgcccatggagctgaaaatgacgctgcagaaagcgctgaaggcctcgaaagagcttgcccgccagtatgagcaggacccctctgtgcacgaaatgattgatatggccctgaaactggagggcatgccgcggcacgcctccacgcatgcggccggcgtggtgattacgcgcgaagctgccgatgaatatgtgccgctctctaccaatgacggaaacatcgtcactcagtttcccatgacgaccattgaagagcttggccttttgaagatggatttcctggggctgcgcacgctgacggtgattcacgatgccgaacagatggtgcgaaaaacagagccgggcttttccgttgccggcatttcctacgaggatgcggcggtgttcgaaatgctgaacgcgggcgagacagagggcgtgttccagatggaatctggcggcatgacgcaaacggccgtgaacctgcagttggaaagcctggaggatatcatcgccattatttccctgtaccgtcccggcccaatggactccattccaacctacattgccaaccgccacaacccgcagaacatccgctataaaacgcctcagctggcgcatattttggacgtgacaaacggctgcattgtgtatcaggaacaggtgatgcagatttgccgcgagttggcgggcttttcctatggccaggcagaccttgtgcgccgcgccatgtcgaagaaaaagcaggcggtgatggacgccgagcgcaggcactttgtatatggcagcacagagccgggctgtgaatgcccgggctgtgtgaacaacggcatctctgccgaagtggcgaacagcatctatgatgagatgtccagctttgcctcttatgcctttaacaagtcacatgcagcctgctatgcggtggtggcttatcagacagcttatctgaaatgtcattacccgtgccaatttatggccgcactgctcaccagcgtgctggataacaccaacaaggtcatccagtacacggccgagtgctcccggctaggcatccgcctgcttgcgccggacatcaatgaaagcgacgtgggcttcaccgtgcagggcggcgacatccgctttggcctgcttgcgctgaaaaacgtagggcggaacctgattgaagccgtggtgcgagccagaacgctgaacgggccatatcagggcctgtatgatttttgcaagcgcatgcacggaacagaaatcaaccgccgcgcggtggaaagccttgtgaaagcaggcgcattcgacagctttgcgccaagccggcgcgccagcctggaggcgctggagggcattttgaaaagcgtagagaatgacgcaaggcgaaacctggacgggcagatggacctgtttggcgccttttccggcgccgaaacgcagaggcaaagctacaccattccggaaaaggaagaatacccggtagattcccttttgcaaatggaaaaggaggtaagcgggctttatctttccggccacccgctggatcagtaccgcgaagaaattgaacacctggcgtctcataaggtgagccagcttaccggcgaagatgcgcggcggcacgacggcgagcaggtggttattgtgtgcagcattgtgcgcattaaaaccatcaacacccgttccggcggcatgatggcctttcttacggtggaagacctcaccggcaccatggaagttctggtgtttcccaaaacgcttcaggcctgtgccgtcagtgtgcgggaaaatgcggcggttgtcattcgcgggcgcgtgtcttacaaagaggacgaggccagcaagttgttggccgaccatatttcgcttgtggatgaatatgggaaagacgggcgccggaaggtagatataagcaacaaaaatacaaaagatggcctttggctgaaacttccgtccatgagcggcgataccttcagcgaagtggaaaaccttttggaaatattcgagggcgatttccctgtgtatatgcatttcgaagataccggaaagactgttctggcgccgaggcgcatgtggtgcgtaaagcacgaacttctgcttgaggaactggggcgcatccttggcgggaaaaacgtgaaggttcgctaa

SEQ ID NO: 3084 - DNA, 1854 bp, Subdoligranulum sp.
atggcacaacaaacgcatggcgcccatatgggcggcccgcgcggcgctgccggcatgatgcccggggaaaaggccaagaacttcaagggcaccatggcaaagctgctgcgctacctctcgcgctatcttcccgccatcatcaccgtattggtgtgtgcggcggcctccaccgtgttttccatctttgggcccaaggtgctgggccaggccaccacaaagctgtttgagggcgtgatggccatgcttaccggcaccggcggcatcgattttaccgccattgggcaaattcttctgttcttgctggccatctatcttgccagcgcccttctcagctatgtgcagggctgggttatggcaggcgtggccaccaaggtgagttattccatgcggcgcgaaatttcggaaaaaatagaccgcatgccgctttcgtattttgaccgcgtgccaaacggcgaggtgctgagccgcatcaccaacgatgtggataccgtcacccaaacgctgaaccaaagcctttcgcagattgtgacaaacgtcaccatgatggtgggcgtgctgtgcatgatgctgtccatcagcccactgatgacgctggtggcaatttgcattctgcccgtgagcgtgctgattgtgatgaatgtggtaaagcgcagccagccctacttccgccagcagcaggattatttgggccatgtgaacggccatgtggaagaaatgtatggcgggcatgtggtggtgacggcctttggccgcgaggaagagagccttggcacctttgaaaaaatgaacgcaaagctgtatgatgcggcctggaaaagccagtttctctctggcatgatgatgccgctgatgaactttgccggcaaccttggctatgtgggcatctgtgtgctgggcggctttctctcgctgaacggctccatcacggtgggcgacattcaggcgttcatccagtatgtgcgcaacttcacccagcccatcaaccaaattgccaacatctcaaacgtgctgcagcagacggccgctgcggccgagcgcgtgtttgcctttctggaggaagaggaagagccggccgacccgcaaagcccactctcgcccgagctgattcagggcgaagtggattttgcccatgtgcacttcggctataacccggagaaaaccatcattcacgatttctctgccatcattcgtccgggccaaaaagtggccattgtgggccccaccggcgccggaaaaaccaccatggtaaagctgttgatgcgtttttacgacgtgacggacggcgccattctgctggacggctatgacgtgcgccagtttgcccgcaacgatttgcgcgattcctttggcatggtgctgcaggatacatggctgtacaacggcaccatccgcgaaaacatccgctatgggcggctttccgccaccgatgacgaggtgctggccgcggcaaaagccgcgcaggtggaccatttcgtgcgcaccctgcccgatggatatgacaccgtgctgaacgaagaggccaccaacatcagccaggggcaaaagcagctgcttaccattgcgcgcaccatcatctccgagccgcgcatcctcattttcgacgaggccacctccagtgtggacacgcgcaccgagcttgccatccaaaaggcaatggaccatttgatggagggccgcaccagctttatcattgcacaccgcctgtccaccatccgcgatgcagacctgattctggtgatgaaggacggcgacattgtggagacgggcacccacaccgagcttttggcaaagcgcggtttttatgccgaattgtatcaaagtcagtttgcagacgtatccagcgaggccgtgtaa

SEQ ID NO: 3085 - DNA, 1779 bp, Subdoligranulum sp.
atggaacaaaaccttccctcgcagcagaaaacgtcgcttttgcggcgttttctgccttatctgctgcgctacaagggcattctggtgtttgaccttgtgtgcgccgggctcaccacactgtgcgaattggtgctgccgctgatgctgcgcgccatcaccaaccgcgccgccgaaaaccttgcgtcgcttacgctgggctttattttgcaggtgggcgccgtataccttgtgctgcgcgttttggacgcggccgccaactactttatgcaaagcaccggccatgtgatgggcgcgcacattgaaaccgacatgcgccgcgacgcctttgcccacctgcagcgcctttccgacgcctattttgccagcaccaaggtggggcagattatgggcaggctgacgaacgacctgtttgacgtgacggaatttgcccatcactgcccggaagaatttttcattgccattttgaagggcacggccgcattcatcattctgctgcgcaccaacgtgcctctcacactgcttatttttgcctgcctgcctgtgatgctggtgtgctgcacgcgctttaaccacatggtgcgcgtcaccttccgccgccagcgcaggcaaattggcgagctgaacgcccgcattgaagacagcctgctgggcgagcgcgtggtgaaggccttttccggtgaagaggcggaaaaagaaaagttcgagcgcgacaacgcctcgtttctttccatcaaaaaggatatgtatcactggatggccgctttcaacaccaccacgcgcctgtttgacgggctgatgtacctggtggtgctggtggcgggcggcatttttatgatgcgcggcgccatcgaccccggcgatatggtggcctatgtaatgtacgtcaccaccctgctggccaccatccggcgcatcattgaatttgccgagcagttccagcgcggcgtcaccggcatcgagcgcttttgcgagattatggacgcggaaatcgacattctggacgagcccggcgccaaacctttgcatgatgtgaagggcgaaattgtgtttgaccatgtctcgttcgaataccccgacgaccacaacaaggtgctgcgcgatatctgccttacggtaaaggcgggcgaaaagctggcgctggtgggcccctccggcggcggaaaaaccacactgacgaatctcattccccgcttttacgacgccaccagcgggcacatctttctggacgggcaggatatccgcactgtcaccctgaaaagcctgcgcagcgccatcggcattgtgcagcaggatgtgtacttattctccggcacagtggcggaaaacatcgcctatgggcgcccgggcgcaagccgtgcagacatcgagcaggccgcgcgccttgccggcgcccacgagttcattgaaaagctgcaaaacggctatgacacctatgtgggtgagcgcggggtaaaactctctggcgggcagaagcagcgcgtgtccattgcgcgggtgtttttgaaaaacccgcccgtgctgattctggacgaggccaccagcgcgctggacaacgaaagcgaatacctggtagggcaaagcctggcgcgccttgccaaagggcgcaccacgcttaccattgcccaccgcctcaccaccatccgcaatgcagaccgcattttggtgctggacggcgagcgcattgccgaagagggcacccacgaacagcttctggcccaaaagggcgagtattggcgcctgtggatgggcgctcagaagctgcatgaagaaaccatatag

SEQ ID NO: 3086 - DNA, 1542 bp, Subdoligranulum sp.
atgtgcctgagaatacggcgcaaagcacaaaacgaggagggcggtttcgtggcaaatgacattttgctggaaatgaaaaacatttccaagaccctccccggcgtaaaagctttggacaacgtttccctgacggtgcgcaggggaaccgtgcacgccctgatgggcgagaacggcgcgggcaaatccaccttgatgaaatgcctgtttggcatttacagcaaggacaccggcgaaattttgctggagggcagcccggttcattttaaaacgtccaaagaggcgctggagagtggcgtggccatggtgcatcaagagctgaaccaggccttgaagcgcaatgtaatggacaacatgtggctggggcggtaccctctggtgggcccctttacatccgaaaagaagatgtatgccgatacccaaaaactgtttgaaaagctgggtgtcagcgtaaacccgcgcgccgtcatgagcacgctgcccgtctcgcagcgccaaatggtagagattgccaaggcggtgtcgtacaacgcgaaggtcatcgtgtttgacgagcccacttcgtcccttaccgaggaggaagtggcgcatctgttccgcatcatcaacatgctgcgggaccagggctgcggcatcatttatatctcgcacaaaatggaagaaattctgcgcatttcggacgaagtgacggtgatgcgcgatggcgcctgggtggccaccgagccggccgcagagctgacgatggagcgcattatcaaactgatggtgggccgtgaactgaccaaccgcttcccgccgaaagataacaagcccggcgagacgctgctggaagtgcgggatatgacggccctgtactctgcgctgaaagatgtctcgttcgacctgcacaagggcgaaattttgggcctggccgggctggacggctctgggcgcaccgagctgctggaaaatatcttcggcaccgccacccgaaagaaaggcaccctgcggctgcacggcaaggaagtgaaaaaccggaacgcgcgggaatctattcgcaacggctttgcccttttaacggaagaacggcgcgccacgggcatctttggcatccttaacatacaggagaacaccaccatttccagcctgcccaaatataaggtgcatggccttttgaacagcaaaaagatgcgcgaaagcaccgattgggccattcaatccatgcgcatcaaaacgccgtctcagtttacaaaaatccgctcgctgtcgggcggcaaccagcaaaaggtcattttgggccgctggctgctgacagagccggaagtgctgttgctggacgaacccacccgcggcattgacgtgggcgcaaagtacgagatctatcagctcatcatcaacctggccaagcagggcaagtctgtcatcatggtatcctctgaaatgccagagcttctgggcgtgtgcgaccgcatcctggtgatgtcgggcggccgcttggcaggcgaagtggacgcaaagagcaccacgcaggaagagattatgacgctggcagccaagtatgtataa

SEQ ID NO: 3087 - DNA, 2325 bp, Subdoligranulum sp.
gtggaacattctgtatttatcagctatcatcacgactcttctgtgcaactggtagagcgcatcgtccaggcgctggaaagcagcggaatcaaatgctggtatgccccccgggatgtgcaatccaaatatgcgggggacattgtgcgcgccattgaggagtgcaaggtttttctgctggttatgaaccggtactccacgcattcagagcatgtgctcaacgaaattgactgcgccttcaaccggtttcatcacaaggaggccatccgcctgcttccgttccgcaccgacaaagagaacctgcccgacgacgtaaaatattaccttgggcgcatccacagcctggacggttccgagcccccggaagaagagcgcatctcttccctggtttcccgcattgcctactggcttcaaagcgaagagccagccggcgccggcccggcgcagatgggcagccccgggcccggggctggcgaaattcgaagcaccgccctggttcacaacaccaactttgtgggccgggaggaagagctgcaggagatgcaccggctgcttcggggcgagaacaacaagctttttctttttggcgcgggcggaatgggaaaaagcgagctggcccggcagtatctgcgcaaatttcagggggaatatgccaccctggtgtggttgacctataacaccgatattcaggagatgctcatttccgatcagttccttctgattcgcggcctggaaagcgaaaagcaggacctgaccaccccgcaggccagagaggcctattacgagaaaaagctgaactatctcaaagagcactgcaattcagacaccttgctggtggtggataacctggacatgcaggacccccggctttcccagctgttagaggggcggtattccatgattatcacctcccgcatcagccgggaaaaggaagggtatcaggagctggccgtacagcccctgaaccgctgggaagaccagctggccctgttcaaaaaattctacaaaaggcccctgccgccgcaggaggaaccggcgctgagggaggtgtttcagcgcattggttttcacacctacggcatccagctgctggccaagcaaatgcaggcctctcacctctcccccacagccatgctggattatctgcgcggtgccgccggggcgtcccagcgccgttcgcagctggtgatggcccatgtgctggaggttatggggcaaattttcgatttgagccatctttctccgcaggaagtttccattttgaaaaacatggcgcttcttccggtggaaggggtagaaaccgagctgttctttgacctgactggcctggaagactttatgttgttggatcagctgattgacagcagcttcatccaatacaactgcatttccgacacaatctcccttcacccgctgatggtggacaccatggtgcaaaaataccccgggtttccccgggattgccaggtttatgtggaaaacctcacccagcggctaagccggtttactcactgcaaatatcaggaaaaacaggtgcttctctccctggcggaaacctactatctcaaatggtgcgacccctccgtgcccttcaatgtgccctttatggaacggcttggagaggcctgcgcggaatattttctgcgggataaaagcattgccattttcgagcggcttatcacccttcaccccacccctgtgcgggagagctggtaccactactacattgccaaccagcggcggtgcatggagcagtacgcccttctttctcaagaggccgcctgcgcgctggaaatcatccaaactgttcccccttccccagagagagaccagcagctctctctgtgctattccatgatgggatgggccaaatatcatgaggagcgtttggaagaatctgaccagtatttccagcaggcccttcagcttcggcggaagaccctcccggacgagagcccgctcattgcctgggcctattacaacagggccggcgttctgaaaaaaatgaaccggctggcagaggccatagagggttacgaagaggccatccggcggtttgaagccattgacgaaattggcatctgcgtgcccgcctatctcagcgcagcggaggcatacctggagctgaatgagctaaaagaggccgagcaggcgcttgcgcaggcgttcgcttacgaatacgagtattatggcgaggaaaactgccgcaatgactggctttacgaggtaaaggccaagctgctggcccggcagggaagagaagaagaagcccaaaaatacagccagatggcacagcttgcacaccagaaatacctggacaaaacataa

SEQ ID NO: 3088 - DNA, 3531 bp, Subdoligranulum sp.
atgcgcaggacgtaccgaaaaaacattttgcgcaccgtgcgtgccagcctctcgcgctttttggccatctttgccattgtggcgctgggcgtgggctttttatccggcctgctggccagccctgtcgatatgcgcctttcagcggatgattattgccgcgcgctgaatctttatgatattaaaattcaggctacccagggcctgacagagggcgaccttaacgctgtgcgcagcacggaaggtgttggcgcagtgatgcctgcctatgatatggacctgatgctgaagagccagacgggtaaaactttgaccacccggctgatgagcattcccggcgatggcgttgaagaagaagataagctgaacgaccttgtgctggtagatggaaggatgccctctgcccccgatgaaattgttgtgggcctgaccaaagatttttctggtgaccgcccgcaggtgggcgatatattaactgtaagcgcagataacgaagaaagcatctcggacgccctgcccgattctttcaccgtggtgggcaccgtgcgctctgccgcctatttttcggtagaaaccgaatataccaatgtgggcacgggcaccattgccctgtttgcctatgccaatgacagcgcctttgagatggattattacaccaccttctacattgcggtagacggcgcgcgcgagctgaactctttttcttccgcctatgaagaaaaggtggggcaggtgtatgcccggctggatgccataaaggacgagcgggccaaattgcggtatgacgagattgtgggtgaggcacaggcccagttggacgacgcccgggcagaatacgagaagggcaaggcggaagccgaagccgaactggcggatgccgcgcaagagctggagacaggccgggccgagctggcggatgcagaagcccagcttgccagcgcaaaaaaggaaattgatgacggccaggcccagctggacgcggggcgcgcccaactgaatgcacagctgccgggctaccgccagcagattgcagacggctatgcccaaattgaaagcgcccaggcccagatagacgaaaaccaggccctgctggacgaagccaaagccccgctggcagcattaaagcagggcaaagaccaattttggaatgtggccgtgccgcagctgagcgccgctttccccagtttgggcactgccttggcaaacattgagggcgccgcagagcagacggatagcgccaccatccaggccattgacctgatcacccaatttgtggaggccattcctccttccggctccggccagggtggcacagaccccggccagggtggcacagaccccggccagggcggcacagaccccggccagggcggtacagaccccggccagggtggtacagaccccggccagggcggcattgaccagggcctgttggatgagtatctgcagcagtttcagaaaataaaatctggccttgaggccttagcggcccaagagcctcccaccacattggacgaggcccttgcccagctggacacacagcaggccgcactggacgcgggccaggcaaagctgacgcaggaactggccaacctgcaggccagcgagcagcagctgaaccaaaccgttgcctcggcccaggcatcgttcgatgccgcagaggccaagctggcggatgcgcgccggcagtataccgatgggatggttgagctggaaaacggccggcgggaactggccgacggcgaacaggcatacgaagagggcaaagccgaggcacaggcagagctggacgatgcctgggagcagattctggatgcagaaagcgatgtgcgggaaattgaacagggcaagtggattctgggagaccgcgatgataatgtaagtttttccagctatgacagcaacgcccagcgcatcgccaacatcgccaccgtatttccggtgtttttcttcctggtggccgccttggtggcgcttaccaccatgacccgcatggtagaggaagagcgcctgcaaattggcaccatgaaagcgctgggctattcccggggaaaaattgccgcaaaatacctgctatatgcgcttgccgccagcctggctggcagcgcggtgggaatggttattggaatgcagctgttcccgagcatcattttaaatgcctacaatatcatgtacgacctgccggttctgaaaacgcctttcaacacgcttttcggcgccattgccacgggcactgcggttgcctgcaccctgctggccaccctgaatgcctgctgggccgaactgcgtgaacagcccgccagcctgatgctgccaaaggcgccgaaagcgggcaagcgcattttgctggagcatatccgccccgtctggcggcgcatgcgttttacccataaggtgacggcccgcaacctgttcctgtataaaaagcgctttttcatgacagtggtgggcattgcgggctgcaccgccctgttggtgacgggcttcggtgtgcgggattctatctcggacattgtggaaaaacaatttgacgatttggcgcactatcagctgatggtgtcgattcaggatgaaagcgccacccagggcaaagagctgcaagcgctgctgaacgacacctcccgcatcacgggttacctgcccgtggcccagcaagatgtgacggtggtgcccgaaggcgatgcagcggcagacaacctgtacatcaccgtacccacagatacggtggcgatgaacgattactttacattccgccaccggaatggcggcggctcgatagagctgggcgagggctcggtgattattaccgagaagctggccgagcggcagggccttaaggcgggcgacatcatcacggtagaggatgccgacgggaacaccgcaagttttaccatcaccgacgtttgcgaaaactatatttcccattacctttatatgagtgccggtgtctatgaggcggcatttggcaaagcgccagaaacaaacctgcttttgtgccagctggccgatggcatggatgaagacccgcaggcggaagaggcccttgccacggaactgcttcaatgccgggacgttgcaggcgcgcagttcacgcacgaacttaccgccagcttcagccaaagcctgggcagcatcaattacattgttgtggtgctgattatagcggccggtgcgctggcctttgtggtgttgtacaaccttaccaacatcaatatttcggaacgcgcgaaagagctggccaccatcaaggtgctgggtttctatgattccgaggtgggcgcctatatctaccgtgaaacttcgctgctcaccctgattggcacagcctgcggccttgcatttggcgtggcgctgcacacattcgtcattcgcacggccgaggtggatatggttatgttcggccgctccatttacccgctaagcttcgtctggtcggccttgctcaccatcctgttcagcctgctggttaacgccgtgatgtatcgaaagctcaaggccatcagcatggtagaaagcatgaaggccccggaataa

SEQ ID NO: 3089 - DNA, 1386 bp, Subdoligranulum sp.
atgcagacggtacagtttgaaagaaacagtgcggcggcagatatcattgcagcttattacaggcatccgccaaagctttatgtgcattcgttcggctgccagcagaacgtaaacgacggcgagaaaattgcaggcgtgttatgtgatgttggcttttccatgtgcgacagggcggcagatgcagatatgattgtgtttaacacctgtgccgtgcgcgagcacgccgagcagcgcgtgttcggcaacgtgggtgccctgaaggcactgaaagaagaaaaccccaagctgatgattgcagtgtgcggctgcatgacgcagcagaaaagtgtggtggataaattccggaaaagttacccgtttgtggatatcgtcaccggggtgaacaaaatagaccttctgcccaagctgctgtgcgaccgcattgccaagcgccgccgtgtgcttcaggcgccggatgaccgtcccgacatcatagagggcatgcccctgcagcgcggctgcagtttccgcgcgtggctgcccattatgtacgggtgcgataatttctgttcttactgcattgtgccctatgtgcgcgggcgcgagcgcagccgcaccagcgctgaaattatggaagaattccgcggccttgtggcacagggctataaagatattacgctgttggggcaaaatgtgaattcctatggcaaggggctggcggagaaaaccgatttttccgacctgcttgccatgctggatgccgtgcccggcgattaccgcatccgttttatgacaagccaccccaaggatgccacccgtaagctgattgacaccattgcggcttccaagcatatctgccatcatctgcatttgccggtgcaatccggttcggacgatgtgctggcgcgcatgaaccgcagctatacggtggaaaattacctggggcttattcgctatgcgaaagaaaaaataccggatctgacactgtccagtgacattatcgtaggcttcccggatgagacggaggaagattttgaaaaaacgctggagctgattcgggccgtgcgttacacacagctttttaccttcatctattccaagcgcggcggcacgcgcgctgcctctatgccggaccatgttacccatgcgcagaagacggcgcgcatggcgcgcatgctggaagtgcaggacgggattgtggccgagctgtgcgagggcatgctggggcagtgccagcgtgtgctggtagagggccccggcagggaagctggcattatgacaggccggctggataataatatgattgtggaatttcccggcacagacgaaagcctgacagggacattccacacggtgcaaatcaattctgcaaagggcgcggtgctgaagggcacgctgaaggaatga

SEQ ID NO: 3090 - DNA, 2205 bp, Subdoligranulum sp.
atgttgaaattgcaacggtatctgaagccgtactgggtgctgctggtgtgcgctatggtatttctgttcggccaggccatgctggagttgacgctgcccaacatgatgagcgacatcgtaaacaccggcatccagcaagggggcatcaccgaggtggcacccaaggccatctcggccgacggcatggcgctgatgcaggctttcatgtcagaagaggacgcggccactgccatgcagcagtatgcccgcgtggaggatgcggccccctatgcacagacatacccgaacctgaaggccggcgattatgtcctgaaagaggacgccgataccgcagcggccgacaccgccttttcgcgcgccagctacgcctgtgtgcaggtgatgcagggcctgatggcggaaaatggcgccgcggcacagggggaagacggcgctgcagcgctggaagcaggccagctgtcgcagctgctgcccatgctggcccggctgcctgagggcacggtgcaaaacgccattcaaacggcggccagcgcgccggacatggcgctggaacagacggccagcgtgtttaccaaaagcttttatgtgcagcttggcgcagacacagacgccatgcagacgaactatatcctgatgaagggccttgagatgctgggcttcaccgtgctgcttacggcgtgcgccattgcggccggcttctgcctggcgcgcatgggcgccggcgtggggcgcgaccttcgccgcgatgtgttccgccgggtaacctacttcaccaccggcgagctggaccagttctccaccgccagcctcatcacacgcaccaccaacgacatcacccaggtgcagacatttctctccatgggcctgcgcctgatgtgctttgcgcccatcatgggcattggcgggcttattatggggctttccaagtgcgtgtccatggcgtggattctgcttttggcgctgattgtgatgctgggcgttattctggtgctgttcgtagtggcgctgccgcgcttcaagaaaatgcagcagttcatcgacaagctgaacctggtcagccgcgagcatctctctggcctgatggtcattcgcgcctttgccacacaggattttgagcaaaagcgcttcgacaaggccaataaagacctcacctccaacacgctgtttgtgaaccgcgccatggtgacgatgatgcccgtgatgacgctggtgatgaacggcgtcagcctgctgattgtctgggtgggcggccaccaaattgcccaaagcaccatgcaggtgggcgatatgatggcattcattcaatatgccatgcaggtcattatgagctttttgtttatcagcatgatgtttgtgatggtgccgcgcgccaccgtttcggccgagcgtgtgaacgaggtgctggccacacagccctctgtgcgtgacaaagagcagccgcgccacctgccgcagcccgtgcgcggcgtggtggagttccgcgacgtgtcgttccgttacggcggggcggatgagcccgtgctgcaccatgtcagcttcacggcaaagcccgggcagacaacggcgttcatcggctccaccggttcgggcaaatccacgcttgtcaacctcatcccccgtttttacgacgtgagcgagggcagcattctgctggacggcgtggatgtgcgcgatgtgccgcagaaagagctgcgcggcgccattggctatgtgccgcaaaagggcatgctgttctccggctccattgcctcaaacctgcgctatggcgatgaacaggccagcgacgaagcgctgcgcaccgcatgcgacgtggcccaggccaccgaatttgtcagccagctgccggagggccttgacacctatgtaagccagggcggcaccagcgtttccggcgggcagcgccagcggctttccattgcgcgcgcgctggtgaaaaaggcgccggtgtatatctttgacgacaccttctctgcgctggatttcaaaacagacgccaagctgcgcaaggcactggcaggctatacagacggcgccacagtgctgattgtggcgcagcgcgtgtccaccatcatgcacgcagagcagattgtggttttggacgagggccgcgtggcgggtatcggcacacacaaacagctgctggaaacctgtgaaacctatcgcgaaattgcgcaaagccagctttcaaaggaggaattggcataa

SEQ ID NO: 3091 - DNA, 2184 bp, Subdoligranulum sp.
atgagcattaccattgcgcttgcaggcaaccccaactgcggcaagacgacactgttcaacgacctgacgggctccagccagtatgttggcaactggccgggcgtcaccgtggaaaagaaagagggcaggctgaaaggccataaggacgttgtcattcaggacctgcccggcatctactctctcagcccgtacacgctggaagaagtggtggcccgcagctatctggtgaacgagaagccggatgccatcatcaacattgtggacggcaccaatatcgagcgaaacctttacctcaccacgcagcttatcgagctgggcctgcctgttgtggtggcggtgaatatgattgaccttgtgcgcaaaaacggagatagaatagaccttgcgaagctgggcgccgaacttggctgcaccgtgatggaaatgagcgctttgaagggcgagggcagcatggccgtggcggaaaaggccatcgaggcggcaagggcgaaaagcgtgggcgaacacccgcatgtgtttaccggcagcgtagagcacgccattgcccacattgaagagtctatttccggaatggtagacgaacaaaacctgcgctggtatgccattaaggtgttcgagcgcgacgagaaggtgagcgccgggctgaagctggacgctgcgctggcacagcacctggaagagcatattcaggattgtgaaaaggaaatggatgacgatgccgaaagcatcattacaaaccagcgctattcctatatcagcaaagtggtagacagatgtgtgaagaaaaaggcggcaaagcacagcctgtctgcttctgataaaatagaccgcattgtcaccaaccgcgtgctggcgctgcccatttttattgtggtgatgtggcttgtgtactggattgccatgggcccgttcggcacattcttaacagattggacgaacgatgtgtttggcgaggaatggctgcagggcggcgttggcagcgtgttggaaagctggagcgttgcgccgtggctgcagggcctggtggtggacggcattgtgggcggcgtggccgctgtgctgggctttgtgccgcagatgctggtgctgttcttgatgctctccatcctggaagacgtgggctatatggcccgtgtcgcctttattatggaccgcatcttccgcaagttcggcctttccggcaaaagctttatccctatgctgatcggttccggctgcggcgtgccgggcgttatggccagccgcaccattgaaaacgagcgcgaccggcgcatgaccattatgaccacctgctttgtgccctgcggcgccaaaatgcccatcattggcctgtttgccggcgccctgttcggcggcagcggcctggtggctgtaagtgcctattttatcggcgtggcggccattatcatcagcggcatcatgctgaaaaaagtgaaggcgtttgccggcgagcccgccccctttgtgatggagctgccagcctaccacgtgcccagcgccaagaacgtgctgcacgccacctgggagcgcggctggagctttatcaagcgcgcgggcaccatcattctggcttcttccattgttttgtggttcctgcagggcttcggctttgtggacggcgccttcggcatggtggaggacaacaactccagcctgctggcggccattggcagcgccattgcctttatctttgcgccgcttggctttggcgactggcagtctgcggtggcggtgttcaccggcctgattgccaaagaaaacgtggtttccaccttcggcgtcctgttccatgtgggtgctgaagtggccgaagacgatgccaacctgtgggcgcaggtggccctgcactacacgcagcttaccgcctacagctttatgattttcaacctgctgtgcgcgccgtgctttgcggccatgggcgccatcaagcgcgaaatgaacaatgcaaagtggacgctggctgctattgggtatatgtgcggctttgcgtatgccatttcgctgctggtgtaccagtttggcggcttggttaccggcgaggttgcgtttggccttggcactgtggcggccgtcgccgtcctggcggtgctcatctactttttggtacgcccgaacaaatataacgctgattacaaaaagggctctgtgctttccgcgaaactgagcggcaaagtgcgcgcctga

SEQ ID NO: 3092 - DNA, 1320 bp, Subdoligranulum sp.
atgaaaattgcactgatctctttggggtgcccgaaaaaccaggtggacgccgactgcatggcccatgccctgctgcaggcggggcacaccaccgtggccagcgtggaagaggcacaatgcgtgcttatcaacacctgcggctttattgaaagcgccaagcaggaggccattgacaccattttggaggcatgcagccacaaggcgcagaaccctgcgctgaaagtggtggtgacgggctgccttgccgagcgttaccagcaggagatacgcaaagagatgcccgaggtggacgcggtggtgggcattggctcaaacgcggccattgcgtccattctggaaaggctggaacggggcgaaacgggcattgaaagctacggccccaaggctgcgctgccgctttccggcaagcgcgtgatctctacgccgcgccactatgcctatctgaaaatagcagagggctgttcaaactgctgtacttattgcgcaatcccgctcatccgcgggccgctgcgcagccgcacgggggaaagctgtgtggccgaggcgcgctggcttgccggggaaggcgtaaaagagctgattgtggtggcacaggatatcaccgcctttggcgcggacaggggcaaggtggaaattgcccgcctgctggacgagctgaacaaggtggagggcattgtgtggattcgccttctttacgcctaccccgagcgcatcacagatgaatttgtggccgccatggtgcgcaatgaaaaggtgctgcactatctggacgtgcccatccagcacattgattccgatgtgctgcgcgccatgaaccgcaagggggacgagggcactgtgcgcgccgcgctggaaaagctgcgcaccgccatgccggatatcaccctgcgcaccacactcatcgccgggttccccggtgagacgcccgcgcagtttgaaaagctgtgcgcctttgtgcgccagcaaaactttgcccggctgggctgctttgcctattcggaagaagagggcacaaaggctgcgcagatgacgcaaatgccccttgcggtgcgcgaacagcgcgcagaggccgtgatgcgcatccagacggatcatatggctgcgcggcaggccgcattggtgggcacacaggcacaggtgctgtgcgacggctgggacgaggaaaacggcctgtggctgtgccgcacgcgcgccgatgcgccggatattgacgcggtggtgtgtgtggacggcaatgccgcgctgacaccgggtgaattttatacggttcgtatcatagatagtgatgtatacgatttgtatgcaactttggcggaataa

SEQ ID NO: 3093 - DNA, 1932 bp, Subdoligranulum sp.
atggcgaagaataagacggcatccgcccccaccacaacggcccgcggccagcgtgcgcccaagggcgttttgcgccggcttttgcgcctgctgtttgagttttacccggttttgctgccggttacactggtgtgcatcctgttcaatgccattgtcagctcggttcccgccatcttcatgcagaacatcattcaaattgtggatgacacctaccggtcgggcgattgggcctcggtgtcctctaccattctggggctggtagcccttttggtggttttgtatatcctcagcctggccgccggttttgcctatacgcagatgatggccgtcatcacgcagggctcgctgaaaaagctgcgcgaaaagatgttcgaccatatgcaggacctgcccatcaaatattttgataccaacggccacggcgacatcatgagctattacaccaacgacgtagacaccctgcgccagatgattagccaaagcctgccgcagatgatgatctccggcgtgacgctgctggcggtgttctgcattatgatgtattacagcatcattttgggcctggttgtagtggctggggtagtttgcatggcccttgcagcccgctatatcacaaaccactcttccaaatattttttgcgccagcaggttacgctggccaaggcggaagcctttatggaagagatgatgacaggccagaaggttatcaaagtgttctgccacgaggatgccgccagggccgattttgacaaagtaaacggagagatctttttcaatgcccgcaacggcaaccgctttgccaatatcctgatgcctctgcttggcaacgtgggcaacgtcatgtatgtggtggtggccctggtgggcggcgcgctgatgctggcccatgcgcccaacatcagcatctccggcatggcctttggcatcagcattgtggtgccgtttttaaacatgaccaaacagtttgccggcgccatcggccaggtgtccaaccaggtgaacatggtgattatgggcctggcgggcacgcaccgcattctggcgctgctggacgagcaggaagagaccgacgagggctatgtcaccctggtgaacgcgcgggaaaacgccgacggcaccctgaccgagtgcgccgagcgcaccaatgtctgggcctggaaacacccgcaccacgatggcaccctgacctatacccgcctgcagggcgatgtgcgcttttttgatgttgactttggctatacgccggagaagacggtgctgcacaacattaccctgtatgccaagccgggccagaaggttgcgtttgtaggctctacgggcgcgggaaaaacaaccatcacaaacttgatcaaccgcttttatgatattgaagacggcaaaattcgctatgacggcatcaacatcaacaaaatcaaaaaggcagacctgcgccgcagccttggcattgtgctgcaggataccaacctcttcaccggcacggtgatggaaaacatccgctacggcaacctggaagcctgtgacgaagagtgcattgcggcggcaaagctggcgggcgcacacgatttcatcacgcgcctgccgcagggctacgagacaccgctttcgggcaacggcgccagcctttcgcagggccagcgccagctgcttgccattgcgcgggccgctgtggcagacccgcctgtgatgattttggatgaggcgacctccagcattgatacgcgcaccgaggccattgtgcagcggggcatggatgctttgatgacgggccgcacggtgtttgtcattgcgcaccgcctttccacggtgaaaaattccaacgccattatggtgctggaccacgggcgcatcatcgagcgcggcacccatgaagaactgctggcgctgaaaggcacctattatcagctttatacgggcgcgttggagctggattga

SEQ ID NO: 3094 - DNA, 1950 bp, Subdoligranulum sp.
atgaagaaaaaaacatattatatcaccacccccatctattaccccagcgacaagctgcacattggccacagctacaccacggtggcgtgtgacgccctggcgcgctataaacgcatgcagggctacgatgtgatgttcctcaccgggacagacgagcacggccagaaaatacaggataaggccgcagccaaaggcgtgacgccgcagcagtatgtggacgatattgtggcgggcattaaggacctgtggaagctgatgaatatttcgaacgaccgctttgtgcgcacaacagacgcctaccatgtacagagctgccagaaaattttcacccagctttacgagcagggcgatatctacaagggctgttacaaaggccactattgcaagccctgcgaaagcttctggacggacagccagcttgtggacggcaaatgcccggattgcgggcgcgaagtgtacgaggccgaggaagaggcctatttcttcaaaaccagcaaatatgccgaccgtcttttgaaactgtacgaggacgtgccggatttcattcagcccgaaacgcgcaaaaacgagatgattgccttcatcaaacagggcctgcaggacacctgtgtgtcccgcaccacagtgccctggggcatccccgtgccgtttgaccccaagcacaccatgtatgtgtgggtggacgcgctttccaactacatttccgcgctgggctacggcaacgagacgtatgacgattacgagaaattctggcccgcagatatccacatggtgggcaaggaaattctgcgctttcacaccattttgtggcctgccatgctgatggcgctgggcctgcctttgccgaaacgggtgtttggccacggctggctgctgctggaaggcggaaaaatgtccaaatcgaagggcaatgtggtggccccggtggtgctgtgcggccgttatggcacagatgccatccgctatttccttctgcgcgagattcccttcggcaacgacggcgtgttctcgaacgaggcgctgattgcacgcatcaattccgatttggcaaacgaccttggcaaccttttgtcccgcacggtggccatggtggaaaaatacttcggcggcacgctgcccgaggcgcgccaggccggggagtttgacggcgagctggcacagcttgtaaacgccatgcccgccgccgtgacaaagtgcatggacagcctgcagcttccgcaggcactggccgagattttcaagggcatccagcgcgccaacaaatatattgacgaaacggccccgtgggtgctggcgaaggacgaggcaaaccgtccgcgcctggccgccgtgctgtataacctgtgcgaaacgctacgctttgcggccacgctgctgcagccgtttatgccgcagacggcgccgaaaatggccgcccagcttgggctggacgccagcgagctcacctatgacgcgctgggcgcctttggcagccacgccacctacaccgtgcacaagggcgaggcgctgttcccgcgcatcgacgcggaaaaggaactggaggaactgaggatggaagaagagaaaaacagggctgccgcggccgctgctgcagcccctgcgcctgcgccggttgccgaagagggcgagcccatcgagcacctgcccgaaatcacctttgacgatttcagcaaggtggagctgcgcgtggccagggtgcttacctgtgaaaagctgcccgaaagcaaaaaacttttgaaatttaccctgtttgacggcgagcgcgagcgcaccatcctttccggcattgccaaatggtacgagccggaagagttgattggcaagaatgtggccattgtggccaacctggccccgcgccccatgatgaagggcaaatatgtcagcgagggcatgattctttctgccgatatgccggacggcggcgccaaggtgaccatctacccggacgat

SEQ ID NO: 3095 - DNA, 2007 bp, Subdoligranulum sp.
atggcagaaaaaaacatggaagaaatgtttatcaaccgtgaactcagctggctggcgttcaaccggcgcgtgctggaccttgccaaggataaggccgtgcctttgggcgagcagctgaaatttgcaggtatttacggcagcaacctggatgagttttttatggtgcgcgtgggctctttgtatgaccgcacccttttgaaagaaacggcaaaagagaataaaacgggcatgacgccggcccagcagatagacgccattatgccggccgtgcgcgagctgcaggcacactgcgataaaattgtggcaaagctgtatgacaatattgcccagcacggcctgcagaaggtgaactttgaaaaactttccaaaaagcaggagcatttctggaaacgctatttcctgcgcgagatatttcccgtgctctcaccgcaaattatcgaccgcaggcacccgtttccgtttttgcgcggcggggaaagctatgtgggcgccatgctgcatgaaaaggaaggcaccgcggccctgtttggccttgtgccgctgacaagccagtttcaggaagtggtgttcattcccggcgagaagggcggcgtggaatttgccctgacggatgagcttgtgcttcattttgcagagcttgcgttcggcaaggtgcgcgttgcttcccgctgtgtgttccgcgtgacgcgcaacgccgacatcacggtggacgagggtatgttcgaccatgatgtggattaccgcgaaatcatgagcgaacttttgaaaaagcgccgcaagctggcggccgtccgcctgcaggtgacggcaaaggcgccgcaggagattgtggattatcttcgggaaaagctgcttttgccggaaaagcaggtgtttttccaaacggccccgctgggcctttcggtggcgttcaaattgtctgccaaactggccgccgccaacgacgcctcgctgttttacccgccccggcgccccatgctgcccccggccgggttctctctgtcacaggcggtgcgccagcaggatgtgctgctgtcttacccgtaccagagcatccgcccgtttatcggcatgctgtatcaggctgcgcgcgacccgtctgtcatctccatcaagatgacattataccggatggcgcatgagtccaagattatcgagacgcttgtcagcgccgccgaaaacggcaaagaagtggttgccattgtggaactgcgcgcccgctttgacgagcagagcaacatcgattattccaaacgcctggaagaggcgggctgcaccgtcatttacgggtttgaagattataaggtgcactccaagcttacgcttatcacccgcaagcgggatgggaagattgagtatatttcccagatcggtacgggcaactacaacgagaaaacttcggagcaatatacggatctctcgttcatcacagcagaccaagagatcggcgccgagcttgccgcagtgttcaacaaccttgccgtagagcgcctgacagacaacaccggcgagctgctggtggcacccctgtgctttaaaagtgtgcttttgaaagagatggaccgcgagatagaggctgcgcacaatggcaggccggcgcgcatctggctgaagtgcaattcggtaagcgataaagatattatcgagcggatatcggcagcctcctgcgcaggcatcagcgtgcgcatgattgtgcgcggcatttgctgcatcaaagccggggtgccgggccttacggagcacgtgacagtgcgcagcattgtggggcgctaccttgagcacgagcgcgtgtatgtattcggatgcggcgccgatacaagggtgtatattgcttcgggcgattttctcacccgcaacaccgagcgccgggtagaggtgggcgtgcgcattcgggatgcggccatcaaaaaagagctgttggatatgctggccatgcagctttccgataatgtaaacgcccatgagatgcgcccggatggcacatacgccaaagtgaaacgcaaggag

SEQ ID NO: 3096 - DNA, 1797 bp, Subdoligranulum sp.
atgccgccggaaaagagagttgtgaaaagcggcgcgctgttcgccaatagaaaggggaagcaaatgctgaacaaaaggctgatgggggtggtgcccggctgcaaaaaatatattgcgcagaatgtggccctgcagtggtgtgcccttgccgccaacattgccatgatatttatgctgggcctgtttttgcatgccctgcttcggggcggtgcacagggcggtatgttctggggtatggcggccgtgatggctgccgcggccctggtgcgttttttgtgcacaaaaggggcggcgcgcgctgccttttatgcctcgaaagaggtgaaaaaggccctgcgcgggcttatctaccgcaaattgctgcgcctgggggcggcctatacgcaaaacgtgcccactgcagaggtggtgcagcttgcaggggagggcaccgagcagctggaaacctatttcggcgcttatctgccgcagcttttttacagtatgctggcgccggtcacactgtttgcagcgctgtgcacggtaagcgtgcgtgcggctgtggtgctgatggtgtgtgtgccgcttatcccgttctctatcatggcagtgcagaaatttgcaaagcgccttctgggcaaatactgggggcaatatgccgcgctgggcgaccacttcctggaaaacctgcagggccttgccaccctgaagatatacggtgcagatgaagaccgccaccggcagatgaaccgtgatgccgaacatttccggcgcgtcaccatgaaggtgctgacgatgcagttgaactctatcatcgttatggacgtcattgcctatggcggcgctgcgcttggcattctggtggccgccggggaatttgccgccgggcgcgccggttttgccgggtgccttgccattgttttgctttcggccgaattctttctgccgctgcgggctttgggctcttattttcacgtggcaatgaacggcatggcggccagcggcaagatattccgcctgctggacctgcccgaggcgccggagaaaacggcccctcccggcacccggggcggcattcgctgtgaggggctgcgcttttcctatgaagcgggccgtgaggtgctgcgcggggtggacatggcatttgcgcagtgcgggctgttttccattgtgggggaatctggctgcggcaaatctacggtggcagccgtgctgatggggcgcagcacgggctaccttggcagtgtgacagtgggcgggcagcagctgagcaatatcagcgaggccgccctgatgcgccatatcacgctggtaagccacaacagttatctgttcaagggcacagtgcgcagcaatttgcagctggctttgccggatgcggcagatgaagtgctttgggctgcgctggaaaaggtgaagctggcgggttttctgcgggaagaaaaggggctggatacacccgttgccgagggcggcgccaacctttccggcgggcagcgccagcgcctgacgttggcgcgtgcgcttttgcacgacagccccgtgtatatttttgacgaagccacctcgaacatcgacgtggagagtgaaaatgatattatggcgcttgtgcatgagctggcaaggcaaaagacggtgattctgatttcgcaccgcctggccaatgtggtgccgtctgaacaaatttatgtgatggaacatggcgctgtggtgcaggcaggcacccacactgccctgctggcacagggtgggctgtacggcgagctttggaaaagccagcaagcgctggaacatgtgggaaaggaggctgcaacgtga

SEQ ID NO: 3097 - DNA, 2313 bp, Subdoligranulum sp.
gtggaaggccgcagctttgaagaattgtgcgccatcgcctcttattatgactatctggaagttcagcctgtgggcaacaacgaatacatggtgcgcgagcacatggtggacggcattgaacagatacaggaattcaacaaaactgtgctgcgcctgggtgaaaagctgaacaaaatggtggtggctacgggcgatgtacactttttgaacccggaggatgcagtataccgtgcggtacttcaggcgggtaacggcttccaggacgcagacaaccaggcaccgctgtatttccgcgacacaaatgatatgctgcgcgagttcagctacctgcccgaggcaaaagcgcgtgagattgtaattgaaaacccgaataaaatagccgatatgatagacgccgatgtgcgggccattcccaaagggttatacacgcccaccattgagggggcggacgtgacgctgcgggaagataccatgcgcaatgcaaagcagcgctatggtgaccctttgccggaactgatagaaaagcggctgacgcgcgaactggattccatcatcaagcatggctttgccgtgctgtatgttattgcccagaagctggtgctaaaaagcgaagagtacggctatctggtgggctcgcgtggttcggtgggctcttcggctgtggcgcatttttctggtatttccgaggtaaacagcttgccgccgcactacctgtgcccaaaatgcaaatggagcgagttctatacggatggttcggtggcggacggcttcgatttgccggacaggctttgcccgcaatgcggggaaaagctgattgtggatggccatgatattccgtttgagacctttttgggctttgatggagataaagagccggatattgacctgaacttttccggcgatgtgcaaagccgcatccaccgctacaccgaggatatcttcggcaaagaccatgtgttcaaggcgggcacaatctcgggcctgcaggataaaacggcctatggttatgtaaaaaaatatctggaagagcgcggccgcaccgtgaaccgcgcagaggaaaaccgccttgtgcagggctgtgtgggcgtgaagcgcaccaccggccagcacccgggcggcatggtggtggtgcccagcgaccacgacgtgtacgatttctgcccggtgcagcaccctgcagacgataaagaaaaaggcgttatcaccacgcattttgaatttaaatacctgcacgataccattttgaagctggatgagctgggccacgacgtgcccaccatgtataaatatctggaagatatgacgggcatcaagatggcggatgtgcccatgaacgacgagaaggtgatttcgctgcttgtctccaccaaggcgctgggcgtcacaccggagcagattggcagcgaaaccggcacatttggcattccggagctgggcacccgctttgtgcgcaacatgctgattgaagcacagcccaaaagctttggcgacctgattcagatatccggcctctcgcatggcacagacgtgtggaacggcaacgcgcaagatttgattcgcgacggtgtatgcaccatttcggacgtgattggcacgcgcgattctatcatgacctatctgttgcacaaaggggtggagcccaaacaggcgttcaacatcatggagttaacgcgcaagggcaaagtggcaaaggctggtttcccggagggcgtggaagatatgctgcgccagcacggcgtgccggaatggtatttggacagctgcaaaaaaatcaagtacatgttccccaaggcccatgctgtggcatacctgattgcagccatccggctaatgtggttcaaggtgtatcatccgctggcgttttatgccacttatttcaccgtgcgcggcgaagatattgactacgaagcggccgtgggcggcgtaaaagtggccttgcagcatatgaaagagatagaacagcgccccaaagaggaaaaaacagccaaagatgaggatatgctggcttcgctgcaaattgtgaatgaaatgctgcagcgcggctacgagtttctgccggtgcgcattggcaaaagccgggcaaagacgtatgtgattgaggatggaaagatccgcctgccgtttatggccctgaaaggccttggcgaggcggtggccaccgcactggaagaggcaacgatgaatggagagcagtatatctctgccgaagagctgcaaacggcctgcggcgcctccagcacaattatggaccttttggcggaaattggcgcgctgggtaaccttcccaagacaagccaggtttcgtttttttaa

SEQ ID NO: 3098 - DNA, 2853 bp, Subdoligranulum sp.
ttgacaccggaaagaggaaacactttggcaaacgacaaaattgtgattaagggcgcccgcgagcacaacctgaaaaacattgatatcaccctgccgcgcgacaagttcatcgtgatgacggggctctccggttctggcaaatccagcctggcattcgacactatttatgccgacggccagcgccgctatatggaaagcctgtccagttatgcgcgccagtttctgggccagatggaaaagccggatgtggacgagataagcggcctttcccccgccatttccattgaccagaaaacaacttccaaaaacccgcgctctaccgtggggactgtcaccgaaatttacgattatcttcgccttctgtatgcgcgcatcggcgtgcctcactgcccggtatgcgggcggcctatcagccagcagacggtagaccagatggtagacgaaattttgaagctgcccgagggcacacggtttcaggtgcttgcccccgtggtgcgcgggcgcaaaggcacccagcagaaggaatttgaggccgcgcgccgcagcggctttgcgcgcgtgcgtgtggacggaaacctttacgaactggatgaagaaattgtgctggaaaagaaccgcaagcacaccgtagagattgtggtggacaggcttgtgctgcgcggcgacatccagacgcgccttgccgattccctggagactgccatcggcctgacgggcgggctggttaccatcgatgtaattggcggcgaagaaattatgttcagccagaattatgcctgcccggaacacggaagctctattgacgagctgacgccgcgcatgttttcgttcaacaacccgctgggcgcctgtgaaaagtgcacgggccttggcacttttatgcaagtggacccggccctcattcttcccaacaaaaagctgtctattcgcgagggcgccatcaaagccagcgggtggtattatgcgcccggttccatcagcgagatgtactacaaggctttgggcgaaaaatatggtttcacgctggatacaaagataaaggacatttccaaagagggcatccatgcccttttgtacggcacaaacggcgaaaagctgaatatgacgcgggagacagaccgcggcaccggccgctacgtgaacgacttcgaaggcattgtaaacaatctggagcgccgttttcgcgagaccaattcccagtggatgaaagacgaaatcagcggtttcatgaccggtgtaaattgccccgactgccatggcgaccgcctgaagcccaccgtgctgggcgtgactgtgggcggcgtgaacatcagtgatttcacaaagatgagcgtgcgggaagaacttgccttcctcaatagcctggaactgacgcagcgcgaacacatgattgcggacggcattttgaaagaaattcgcgaacggctgggctttttgcagaatgtgggccttgcctatcttacgctggcccgcagcgccgctaccctctctggcggcgaaagccagcgcatccgccttgccacacagattggttccgccctcacgggggtcctctatgtgttggacgagcccagcatcggcctgcatcagcgcgacaacgaaaagctgattgccacactgaagcgcctgcgtgatttgggcaacaccctcattgtggtagagcatgacgaagacaccatgcgcgcggcagaccatattgtggatatcggccccggggcaggcgtccacggcggcgagcttgtggcgcagggcaccgtggaggatatctgcaaggcgccgcgcagcatcacgggcctgtatctctcccgaaaaaagcagatagaagtgcccgaaaagcgccgcaagggcaacggccattgcatcgagatactgggcgccacacaaaacaacctgaaaaacatcaatgtcaaaattccgcttggtgtcatgacctgtgtgacgggcatttccggctctggcaaatcttccctcatcaatgaaattttgtacaaacgccttgcaggcgatttaaatggcgcacgcatcaagcccggcgcgcacaaggatatgctggggcttgaatatgtagacaaggtaattggcattgaccaatcccccattgggcgcaccccgcgttcaaacccggccacctacaccggcgtgttcaccgatattcgcaatgtgtttgcccaaacacaggaggcaaagctgcgcggctatgacgcggggcgtttttccttcaatgtgaagggcggccgctgtgaagcgtgcgagggcgatggcattttgcaaattgagatgcactttttgccggacatctatgttccgtgcgaagtgtgcaaaggcgcgcgttacaaccgggaaacgctggaagtgaaatacaagggcaaaaacatccacgatgtgctggaaatgacggtagaggaagcctgcggcttttttgctaacattccgcgcattcaccgcaagctgcaaactttgtacgacgtgggccttggctatatcacactggggcaaagtgccaccaccctttcgggcggcgaggcccagcgtgtaaagctggcgctggagcttgcgcgccgcggcacgggccaaaccgtatatattctggatgagcccaccaccggcctgcatgtggcggacgtacacaagctggtaaaagtgctggatgcgctggtggacgccggcaacaccgtgattgtgattgagcacaacctggatattatcaaacgcgcagaccacatcatcgacctgggccccgaaggcggcagcgagggcggccgcattgtggcacagggcacgccagagcaggttgcggaaaacaagaactcctttaccggcatgtatttaaagccgcttttatcaaaacattaa

SEQ ID NO: 3099 - DNA, 2316 bp, Subdoligranulum sp.
atgatattgcccggggctgtttttgcgcaggaaaacttggcggccgccccggcctgcacccaaaacgaagggtgccaggccacccagcataagccgggctgcccggtggggcaggcccttttgcaggacgacgacccggggaatatgcctgcgaacgggaacgcgcctttgaacaacgaagacgacgacccggggaatatgcctgcgaacgggaacgcgcctttgaacaacgaagatgacgacccggggaacatgcctgcgaacgggaacgcgtctttgaacaacgaaggcgggcaggcggcgcccaaggcggccggcccttatgagtacaacggtgtttcctacccggcattatccgatgcggtgaaagccgttggggcacgggcggggaccgtttatgtcacggaggatgcttttattcgaagcaacgagattatcgagattcctgcgggcgctgacattaccatcaccagcaaaggcggggctgcctttcgaattacaaaagaggcacaccggtttgtgtttaaactgctgggcgggaagctgaccctggaaaacattattttggatggaaacgcacaatggaaagacgcctcctccgggctgtggtacgagcgcaccgcacagggcactgcggcatcgctgccgcttatttatgcgcaagcccaggtgggcgggcaccccggttcgggaagccggcttgttttgtcaagcgggtgtgtcatccaaaacttttatgtaaaccgcgcagcggacaatatcgatacagaccctgttctgggcggctggtccggaagtgaagagctttgcctgcttagcctggcaaatacggatgtgaccatccatggcgctgttctgaaggacaatgcagtgaaatcggacgtggcgttttaccgcaatgcctatgggcgcggaatcatctgcccgggcatcattcaggcaatgagctgtacgattaaaatgaaagacggcacgatggcgcgaaactggattgtttcagatgtagggcattccgcagagggacagggctggctggacgcccagagaagccggtattccagtgcgctgcgcgaaggggcgtccggcggccatctgacgatgacgggcggacggtttctcatggaagggggaaccctgagccagggctatgcggcggatggcggcgcaattgccgcgcttgatgccgaaatcgttttaaccggcggcaatattgtggataatgttgccgaaaggtttggcggcggggtgctgatgtgggacactggatgcaaatttaccatgaagggcgggcgcatttcggggaacaagacgctgaaccgcatagccggctatgacgactctgtgcgcaaaacagttggctgtggcggcgccctgtgcatgacgggcggcgatgcccagggctctgaacttcgtattaccggcggggaaattagtgacaacagcgccgtgcagggcggcggcatctggctgaaccggtgcagcggcgaaatcagcaatgcagccatacggggcaataaagccctgccggccgcggaaaacatgttgggggcaggcggaggcattctgtttgcaaacggcacactggccctggacggaaacacggaagtaagcggaaaccacgccgtgcagggcggcattgcgaacggcgcaagggggcagcttattgtaaagggcagggccggcatccggggaaacgaggcaacctcccttggcggtggcctgtgcctgaacggggtaggaatctccagcattttgatggagcaggcaacgattgcaggcaacaaagccaatgcgaagaacggcggcgatgcagtgtttatcttttcccccagcgaaaaggagattcccaaattttttctgaatgcgcaaaattccgaactgaagggggatattgtgctgcatgcggcaaatgaaaaagcgcttccggttctttccctgaacgcggcggtgcctgcaagcaaacgctatatggtgaaattttatgatgcggcctatgcaacgcgcggccgaaggcttgtggcacccggggcctatggcctgccgggagaaaaagcaatttcaagcgcagagccctatgcgcaaagcttccaaaataatgtgatggatgtcattccgggcagtttgcttcaagagctcaccgcccttgtgcttggcaagaaaccggccgtgcccgcgccggcagccagcacggcgcccgccagtgcgccggccgccgcaggggcgaaaaagaccccgaaaaccggcgtgccaaacacaggcgggaatagccctgcgcccgaacacccgcttgagggcaacggctttttgtgcccgtga

SEQ ID NO: 3100 - DNA, 2241 bp, Subdoligranulum sp.
aaacggatgatgcagtacccgcagtgggagggctttgcgcccggcgaatggcagcgcggcattgacgtgcgcagctttattcagaaaaactttaccctgtatgagggtggggaaaaattccttgcgcccgccacggcgcgcacgaaagccgtgtgggaaaaatgcgaggcgcttttgcagcaagagctggaaaagggcgtgctggacgtggagacaaagcggttttccggcattgatcatttcgagcccgggtatatcgacagggacaacgaggtgattgtgggcctgcagacggacgcacccttgaagcgcattgtgaacccttacggcggcatgcgctgtgccaaggctgcgctgcagcaatatgggtatgcgctggatgaagagatggagaaaaccttctcggaataccgcaaaacgcacaatgagggcgtgtttgacgcatacccgccgcgcgtgcgcgcagcgcgccatgtgggcctgctgacgggcctgccggacgcatatggccgcgggcgcatcattggcgattaccgccgcgtggcgctgtacggcattgacgcgctggccgaggccaagcgccgcgacctggacgcgctggatggccccatgacagaggagcgcatccgcctgcgcgaagaggtgtctgagcagattcgcgcgctgggcaaaatcaaggccatggccgcgcgctatggcatcgacatttcccgccctgccagggacgcaaaagaggcggtgcagtttttgtacatggcctaccttgcgggcatcaaggaaaacaacggcgccgccacctcgctgggccgcacctccaccttcctggatatctacattgagcgcgacctggcgcgcggcgccatcacagaggccgaggcacaggagttaattgaccagttcgtcatcaagctgcgcctggtgcgccatctgcgcacgccggattacaacgagctgttcggcggcgaccccacatgggtgacagagtcgattggcggcatcagcctggacggcaaaccgcttgtgaccaagacgtcgttccgcattctgcacacgctgacaaacctgggcactgcgccggagccgaacctcaccgtgctgtggagcgagcatttgccccacaaattcaagcgctactgcgccaaaatgtcgattgcaacagattccatccagtacgagaacgatgatatcatgcgccccatctatggcgacgactatgccattgcctgctgcgtctctgccatgcgtgtgggcaagcagatgcagtttttcggcgcgcgctgcaatttggcaaaggccctgctgtacgccatcaacggcggtgtggatgaaatcaagggcggcgtcattgtaccgggcatcgaacccatcacggatgaagtgctggagtacgacaaggtgcgtgccaactacgagaaggtgctggagtatacggccgggctgtatgccgacaccatgaacatcatccattacatgcacgacaaatatgcctacgaggccgggcagatggcgctgcacgacacaaatgtagagcgcattatggcatttggcgtggccgggctttcggtggcggcagattctctttcggccatccgctgggccaaggtgcgcccggtgcgcaacgaacagggcattgcagtggattttgccattgagggtgatttcccgaaatatggcaacgatgacgaccgcgcagacgacgaggccgtatatctggtgaaaaagttctcttccgagctgaaaaagcacccgctgtaccgcaacgccatgcatacgctttccgtgcttaccattacctcgaacgtgatgtatggcaaaaagacgggctctacgccggatggccgcaaggcgggcgaggcgttcgcccccggcgcaaaccccatgcatgggcgcgacagccacggcgcactggcgtcgctgaactcggtggcaaagctgccctaccgcgacgtatgccaggacggtgtgtccaacaccttctccatcatccccaaagcgctgggctgggacgaagagagccgcgaggtgaaccttgtgtccattctggacggttacttccagcagggcgcgcaccatttgaatgtgaatgtgctgaaccgcgagttgctgctggacgccatggaccacccggaaaaatatccctcgcttaccatccgcgtatccggctatgcggtgaattttcatcgcctcagccgtgcccagcaggaggaagtggtgcgccgcaccttccacgaggctgtgtga

SEQ ID NO: 3101 - DNA, 1332 bp, Clostridium sp.
atggaaaaaacattttggaatcgtgtcaacaacaaagaacttctggaacaggtaggcgacggcaaagaagtcatctggatcaatgaaaaccaggaaaaaaccgctgacgcattggcaaaaatcaacatcacaatggcagatattgacgatgcagaagcaagattggctcgttttgcgccgtttatcaaaaaagtctttcctgaaacggaacctcagaacggcttgatcgaatctcccctcaccgaaatccctcatatgcagaaacagttggaagaagaatacagcacctccattcccggacgtttattcttaaaacaggacagccatctggcaatctctggctccgtcaaagcaagaggcggcatttacgaagtattgaaacatgcggaagacctggcactggaacacggcaaaatcaaactgactgatgattattccgtattcgcctctcccgaattcaaggaatttttcagccagttcaagattcaggttggctccaccggcaatctgggcatgagcatcggtatcatgagtgcggctctgggcttccatgttattgttcatatgtctgctgatgcgaaacagtggaaaaaagatctccttcgccagcgcggtgcagaagtcatcgaatacaatgacgattacagcaaagctgttgaagtaggcagaaaaaattctgacgctgatccttccagctattttgtagacgatgaaaactctgtaacactgttccttggctatgccgttgctgcaaaacgcatccaaaaacagttcgtggaaaaaggcatcactgtggatgcagaccaccccctgtttgtttatattccctgtggtgtaggcggtgctcccggcggtgttactttcggcttcaaacagctctttggcgacaatgttcacgttttcttcatcgaacccacacaggcaccttgtatgctggttggtatggcttccggtctgcaaaacgaagtttccgtacaggactttggcttgagcggacagacccatgccgatggtctggcagttggccgtgcttccggttttgttggtggcgtcatgaaaaatctgctgtccggtatcctttctctggaagactatcacatttacgatctcatgcgtgacatcgtcaatacagaggacatcttcctggaaccttctgcatgcgcatccttctggggccctattcagctgaaatcccctaaaatgcaggcatatatcgaaaaaatgggtctgaaagacaaaatggcaaatgccgtacatattccctgggcaacaggcggcagtctggttcctgcggaaatccgtgaagaatacatgcacacacatctgaaataa

SEQ ID NO: 3102 - DNA, 1119 bp, Clostridium sp.
atgactgattgggatggattattgaaaaaagaagaacagacggtgtttcgtctgcgggcgctctttgagcagtatggctaccgcaaattcaaaatgagcaagtttgaagaatatgatttttatgcagaaaacagaagttttttgacaacgaaaaatatcatcacgtttcaggggttacagggccatttgctggccttgaagcctgacgtgacattgtccattgtaaagcataccaaaggcagttatgactgtcccgagagagtatattataacgaaaatgtatatcgtgccagaaaggacgatggagaatataaggaaattatgcaggtagggctggaatacattggcgaagtggatgattacgctgtcagtgaagtggtgctgctggcgaagaaaagtctggacagcatttccagccgcagtgtgctgaatctttctcacatgggctttgtacaaggattattggaagaaacggctctttcgccttcccagcaggagaaaattctggtctgcattggtgaaaaaaacgcccatggcattgcgcagatttgtaaggaaaacggtgtttctgaagaacttacaagccgtttgcagacattggcatccatccatggcagtctggcggaaattctgccaaaagcaaaaggattgtgcggcaatgaaaaagcacaacaggccattgaggaactggaacggctttatgcgaacttgaaagcttgtgtttacgaccatggcatccatctggatttttccattgtcaatgatatggattattataacggcattattttccagggttttgtggatggtatccccacaggggtgctttccggcggcagatatgacaatctggtgcataaatgcggtaagaatgccgacgcactgggatttgccgtttatatggatatgctggaacgctatggcgaagaagaaaagtcttacgatgtggatgcattacttttatgcgatgaaaatacagataccattggaaaactgcgggcagtgcagatgcttcaaagcatgggactttccgtggcggtacagaaacaggatgacggcagactgaaatacaaacagctttgccgattgagtgaaagcggggtggaagtcattggctga

SEQ ID NO: 3103 - DNA, 681 bp, Clostridium sp.
atgaaagaacaatggcgtgcggaactgaagtataccgttgggacggcggaaagcaggatgctggcagctcgtatggcggcgtttatggagcgggatatccatggaggcaagacgggatatctggtgcgttccctgtatttcgataatttctataacaaagccttgcgggaaaaactggatggtgtgggcgtacgagaaaaatttcgtatccgctgttatgacgggaatttcggctttatccggctggaaaaaaagagcaagcgctacaatgcaggcaacaagacccagtgccgtgtgacagcagaggaaaccaagcggattttggatggtgacattgggtggatggcagaagacgaacgggcactggtgcgggaattatatctgcggatgcagatggggatttaccgccctacggtcattgtagactatgacagggaggcactgacttacgcaccgggaaatgtccgtgtgacttttgaccgacggattcgaggctgccatcagcctcagttatttttctcggaaaatctgccgtccattccagctattttcccggatcgggtggtcatggaagtgaaatacgacgattatttgccagatattgtgaaccgtaccttactgacggtaaaaacaaaagaacaggctttttccaagtatgcagcctgccgcatcatgtgctga

SEQ ID NO: 3104 - DNA, 639 bp, Clostridium sp.
atggaaaagagcgcgaaacttttagaaatagcagtttcgtgctcttgttttttaggaagaaaagaaagaagggatcatcatgattttggatttgacaaccatactcacaccggaccattccatgatcgcatgggcaaaacaaaggaaaatccccatattgccatgggccatgtgggaacccatttagatacctatgaaaaaacaaaaattccgctggagtatttccgttcccgtggagttttgtttcaggtcgttggaattggggaagtgatagaggcggatattgatctgacaaaggttcaagcaggagattttgttttattccgcaccggaagaagtgaggaatacgcctatggtgaaaaagaatactttcccaatcatcccaaactttctctgtctttgattgaaaaattggtagaaaagcagattcattttatcggtgtggattgtcccggtatccgggagcatgaagagcatcagcaggcagaccgtttttgcgaaagacatggtgtttatgtcattgagaacctgaaaaatctttctggcattacatcagaaacctttacggtttataccatgtggttggatgatgcgcagatgacagggctgagatgccgtgttttggcagagatgaaataa

SEQ ID NO: 3105 - DNA, 666 bp, Clostridium sp.
atgaaagggttgatagatttggtaaagcatagtatcaaagatccggttagtgcgttgacacattttattggcttattggcatgtattccctgtatttctgtattgctctttcaagcttcacaccaagatgcaatcattcaggtcataggttttgccgtgtttggattgtcccttatgcttttgtatggagcaagtaccatctatcatactttgaatgtttctgaagcaaaaacaatacttctgcgcagaatagatcacattatgatttttgtactcattgcaggaacgtatacgcctatttgtcttgtgccgcttgctggggcttggggatggacaatgcttgctttgatctggattttggcaattggtggtgtctttatgaaaattttctggatgcaggctcctaggtggctatctactgctttatatgttattatgggatggctggcagtcattgttttcgttccattgcaagaggctgtctcctggaaggggataggattacttttggctggtggtttggcttacaccataggggctgttatatatggtttgaaaaaacctcagctgcccattgctggatttggttttcatgaaatttttcatgtgtttgtgatgattggaagtgcttgtcatatagcttttatgtttctatatgtgctataa

SEQ ID NO: 3106 - DNA, 939 bp, Clostridium sp.
atggaatatgtttttggcattgatgtaggcggtaccactgtgaaaatcggcctgtttaccacagatggcacattggtggataagtgggaaatccctaccaacacatcaaacggcggcaaagccattctgccggatgttgctgcaagtctggaagaaaaaatgaaagaacggggcattgacaaggcatctgtgaaaggcgctggcattggtgttcccgggccagtcacagacgatggtgtggtaaaccattgtgtgaatttgggctggggaattatgcatgtgacagaagaactgaaagctctgacaggatttgaagtaaaagcaggaaacgacgccaatgtggcagcccttggagaagtatggaaaggcggcggcagaggatatgacaatgtgttgatgattaccattggcacgggtatcggcggcggcctgattctcaatggcaagattcatggcggtgtcaccggcagtgcggcagaagtgggacatatctgcgtcaatccgctggaaacagaaccttgcaactgcggaaactgcggctgtctggaacagtatacttccgcaacaggcattctgcgcatggcacagaaaaaactggcggaaacagatgcaccttccattctgcgcggcaaagctgatctgaccacaaaagatgtcattgatgctgcaaaagaaggggatacactggcaatggaagtgtttgactttatggcaaagaccatgggtatggcactggctggatgttgcgcactggcagatatggaattgatcctcatcggcggcggtgtgtcaaaagcggggaattttttgacagatcccatcgagcagtatttccgtacatttgctttccacactcaaaagaatacaaaattcaaactggctgaactgggaaatgatgccggcatttatggtgcggcaagaatgatgatacatgactga

SEQ ID NO: 3107 - DNA, 474 bp, Clostridium sp.
atggagaaaaaaaacctgcgttattccatcaacgcgtcagccatcagcaggtatgccaaccggaatttcgatctttgtctgcggcatcttcccatcagcagcggacagcagtttttcctgctgcggatctacgaaaacgaaggtatccctttgaacaaactggcgcagctgggcttttttgacaaaggcaccgtcagccgcggtgtacagaagctggaggaagccggctacatccgggtcatcaccgacgaaaacgacagacgctgccggaaactgttcgtcacccccgccgctatgcccatcatcgaaatattgctaaatgccagagaggaatggaactctgctctcacagaaggcatgacagacgaagaatgtctgctcatagaaaaactcatgaaacaaatggtacaaaatgcccaaacctacatcgccaaaaaggaggaggaaatcacatgcaacagcaacgaacactga

SEQ ID NO: 3108 - DNA, 1167 bp, Clostridium sp.
atgaaaaaatttttaagtttttgtgtggcgttgctattgtgtgggcacacagttctggcggcagagccaaatgtggcagcacagggagcggcgcttattgacggagaaacaggacggctgttatggggaaagaatgcggaaagtcctatggaaatggcaagcaccacaaagatcatgactgccatattggtattggaaaaagcagacccgaaagaagtggtgaccatcagcaaaaacgccgcaaaacagccggatgtacagatgggattgaaagaaggagaacaatggtatgcaggggatttgctgcgcgccatgatgctcaaatcctataacgatgcggcagtggcgttggcagagcatgtcagcggttccgtggaagccttttgtatggaaatgacggcaaaagcggcatctattggggcaacggatacagtctttggttcgcccaatggtctggacagtcatttaaccagagaacagcaccattccacacctttggatatgggcattattactgcttatgctctgcaaaatcctgtttttcgggaaattgccgtgctgcccagccatacttttgcggatgtttctggaaaaaaggtacatacggcagtgaatacagatagatttttgcagatgtatgccggtgctcttggggtaaaaacgggatacaccaataaagcagggcattgttttgtaggggcggcggaacaggaggatatgacacttgtcagtgtggtattagccagtggatggggcaacacaggcaaggaagcaaagtggacagatacgaaaagactcatggattatggctttgccacttatgataaacaggaaattgcagaggttggagaaaaaatgggagaaatcatggtgacccgctctccggtggaggaaatcacggcaggtcttggggaggggtacagcggtgtattctcagaagatgaggtttcccgtttacggtggcagacagaattgccggaaacattggaagcgcccatagaacagggggaacagattggtacagctgctttggagctggatggagaaatcattgcggaaattccgctgacggcgcaatcagaggcaccagcatatacattggcagagcagtaccgcagattgctttctgtttggtttggctggacagaatttttgccggaaatgtga

SEQ ID NO: 3109 - DNA, 936 bp, Clostridium sp.
atggaagtatttgtaacagccataaataaactgatcatcatttttttgctggttttgattggctgctttgccaagaaaaaggatatcattgatgattgctttattgataagttttctggatttttgacaaaaatcgttgtgccttgttttatcatttcatctatgcagttgtcctatacaccggaattgctgcaaaaaggcattgtggtgtttatcacctgtatgattatgcacatctgggggatattggtcggttttggtacaggaaagttgttccgtgtgccccatatgaaccttggtatctgggtgttcagctgtatgtttgcaaatatcggcttcatgggagttcctgtaatttccatgatctttgggggaaatagtgtattctactgcgcttttgcatctgcggcttttaatctggcgtcttatacattgggtatctggattattggaaaatatggtgatggcagtcatccagtgcaaatatccctgcgtcagctggtgacactgcctgttaatatcgctatcatcattggaattatactgtttattggcaatattcagctgccggaagcaattggtggtacagtgaaaatggtgggggatatgattgcgcctcttgctatgatttatattggcgctgttttgggacggatgccgctgcgggaaatgatttatgaccgttgggcctatgtgatttccttcattcgtttgattgtcgtaccattgactgcctatctgatgctgcgtccttttatcacagatcagctggttttgggcgttgttattgtagggctgtctacaccaatcggcgcttattgtgctattttggcggcacaatatggagccgatgaaagaacagcatcccgttatattttcatttcaacggctttgagcatattgaccatgccatttttctttttcctatttatttaa

SEQ ID NO: 3110 - DNA, 1422 bp, Clostridium sp.
atgtggaaaggagatacgccgatgaataatatgaaaaaaagcgtcagacggatcttctggctcctggcattttgcttttttctgctgttaggatatctgggcaagttagtgattgtagatcgtgcggaaatatctggtaattcctataatatccgtttgcgtaacgacgaggaaggcatccagaggggtgacattctggatcgaaacagagaagtgttggcaaccagcactttacaggaagatggcagttatctgcgggaatatcccagagggcgtatggttgctcatgtaacgggatatagtagtgtagggaaaaccggtgtggaagcggcttataactttgaattgatgtcagttcatcaagaactgctccagcgcttgtctggtttgatggaaggaaaagaccctaaaggcaatgacgtagtgctgacattggatatggatatccaaagtgctgctggggatttgctgggcagtacaaaaggtgctgttgtggttatggagccttcaacaggacgtattttggcgatgcaggcatatcctgactttgaccccaatactgtttccggcgattgggattatctgaccacagatgaggatagtccccttgtaaaccgtgcaacccaggggctgtatccgcccggatcaacatttaagattatcactgcccttgcggcaatggaatatgtgcccgattggcagagttttacttatgattgcagaggcgaagcagaatttgaaaataaggtgatccattgctacaataataaagcccatggcacggtggatatggaagaagccatggtggaatcctgcaactgttactttgcggcccttgcggaaaaaatcggggcagaaaacctgagcaaagttatgaaggaatgcggcattctttctgattatggttttgcgttggcacacagtcagagcgtgatgtcactgaataaagattcttcagaaagcgaattggtggaaacgtccattggtcaggggaaaacaagcgtttctcctctgtatatggcaatgatgatttctgctgtggcaaatgacggcattatgatgcgtccatatattgttgaccatattcagtatgcaaatggagaaatcggtgatacaactgtgccggaaaaactcatggaaatttgttcgcccacagaaacgagtcagcttaacgatttgctggtaggtgttgtggatcatggtaccggtacagcagccaagatcagtggtgtgactgttgccggtaaaacaggtacggcagaaaatgccacaggcaaagaccattcttggtttgtaggctatgcgccggcagaagatccaaaagtttccatagcagttgttattgaaaatgctgattacggaaaagcaacacccattgcaggagaagttttggaagtggcattggaaaaattggcagaataa

SEQ ID NO: 3111 - DNA, 1569 bp, Clostridium sp.
atgtataatccaaatgaagataaaagagaaaacgataacaacatggagcctatccatggacacggtgaaaatgaacgtgaagaaaaggtattcagcgaaaacgaatcccatgtacaggaatccagagaattggaacagaatgtaacagcggaggatacaaaggcagaagaagtaaaaaatgaacagccccaacagccccaacagacatatcacagtgaaacactgcgggactacacaccggaagatgcacagcccatgtgctttgaatccgaagcggcggaaaagacaggcagcgcaggaaatgtgcatcaggaatctgtcagagaagaaagaacagaagaatctgttcatacagttggccctagagaagaacgcggaaaacaggaaaaaaataaaaattgctatgcggagcatgtgaaaaaacacagcaagaagaaaaatagcggctgggcaaaacttatcgcaggttgcttaatcattggcttggctggtggtacaggtattggtgccggctatggtgtggtagaacagcattaccaaaatgcaggtggcagtacaatgacatccagcggaactgtgaatgtagaaaagacagcaacaggaacaggcatgtccaccattgatgtggtgcgtgccgtaaaaccttccgttgtcagcatcaccacaaaaattgaaggtgtaacttcttactatggtgcttttagtgtgccttatgaaggcgaaggtgccggcagtggtgttattttctattccgatgatgaaaaaattgctatcgtaacaaataaccatgttattgaagatgccacagaagtatatgctaccatcaacgatacaaccagtgtgcaggcgaaagtcgttggcacaaagagcgactctgatctggctgtactgactatctcctgggatgatctgagagcggctggcattgatgaagtaacagtggcaacatttggtgattccgatagtctggaagttggcgaaagtgtcattgccattgggaatgccatgggcttgggcctttctgcaacagatggtattgtcagtgtgaaaaatcagaccatcagtgtggataacaatacgctgaatgtaatccagacaagtgctgccatcaacagcggtaacagcggcggtgccctggtaaacagccgtggtgaggtagttggtatcaatacagcaaaatataattcttccatggcagaaggtatgggctatgcaattccaagcaatgaggttatttccgtagcacaggatctgctggaagacggtacggtaacaacaccttatattggcatcatgggtacaagtatcacttctgaaaatgcatctttgtataaactgccagtgggcgcattgattgtagaagtaacagaaggtggccctgcggccaaagcaggtatccaggcaggggatatcatcacagaattcaatagaaaaacagtcatggatatggactccttatctgaactggtaaaagaaacagaaattggccagacagtttctgtgcatatcatccgcaatggtgaaaaggccatggatgtgcagctgaccgttcaggacaaaaacgcataa

SEQ ID NO: 3112 - DNA, 1533 bp, Clostridium sp.
ttgcttgccaaaaggcagaaatatggttataataaaacggttcataattttgtaaatatttcttcacaattttgtaaaggagatgattgtatgaaacggctggtaggtgtagccgtaacagcacttctgtctgtcagtgtttgttttacagccttcggggcggtttcgaccaatgcttccccttgggcagcgcctcatatggaacaggcatattctttgcagcttatttccgcacctttgcttcagcaggcgcaggataccatgacaagagtggaattcagcgaaattgcggtggctttttatgaaaaagtggcaggaacaacagcacctatgacggaagaaaatcctttttccgactgtaatgaacaagcagcactgaaagcatatagattgggtatcattgctggtgtggaaccgggaacattcgcgccggaaaatcctctgacaagagaacagatggcgatcatgctggtgcgtacactggaaaaagtgggcgttgatatgtctctgtatgcaaagaaaaatccatttacagacaccaaaaacatcggcgcaacgacggtatcctacattgataaggcttatggagctggtttgatttccggttatcagaacggaacatttgcccccaaaaatacattgaaagtacaggaagcagtcactgcgtttctgagcgcttatacattttatgaaggcgtgcagaatggcacttctataccaaaaggcgacgcggtaatggaaaaaacagttaccattaacggcaaggagctggcattgggacagacaacagaagaagtcaaaggaacattcggcgctcctacacgaatcgacgaaacagtatatggcttagatcgctatatttacacaggagatggatatttctgggtgacatttgaaaatgatgctgctgtagaatttttcacaccatccagcaagttccagtatcaggaaatcaagggaggaggagtgctgaacgatgcgtctcatgtggacagcatcagcaatgtggatcattgtgcggtattgaatggagaatatgcttccaccagaattcctctggattatgaaaatcagatttgtggtctgctgcttcagacaaaggaatttgctgcaaaagacgcgttgactggttctttgagcggtgcgcaaaagactgatattgaaaaagaactgctggaaattatcaatgtccagagaaaagaagctggtctggcagttttgacagaaaatcaaggtctggatcagactgcggctgaccatagtacagaaatggtcaaagaaaaatatttcgattacaaaagcaaggatggcaagacacctttccagcgtatgatggaaaacaatgtgcagttccatactgcttcggaagtcattgcaacaacacgaggtgatgtggtgcagctttatacggaactgctccgtacagcggcaaaacacaatggcattatggacagcaccatgacacaagctgggattggtgttgcaaatgatggcaaagtattgtatctgaccattgatttgtgtaacggataa

SEQ ID NO: 3113 - DNA, 531 bp, Clostridium sp.
atgagctatgaagtgttggaaagtaaactgacttatgaaggcaagattgtaaaggtaacagtggataagctgcagatgcctgatggcaaagcggcttaccgtgaaacagttatccgtggcaaaaacgcggcggcagcgctggcagtagacgcagaaggcaagatcatttttgtaagacagtatcgtcatgcttttaaagaaatgctgctggaaatccctgcgggagtgctggaagaaggggaagaacccagcgaaggcatcaaacgggaactggcagaagaaactggcaatctggcaggcaatatggaatttatctgtgaaatctacccaacagttggattctgcacagagaagatcttcctgtattttgcttctgatttgaccccctgtccttgttgtttcgatgaggatgagttcattgaagtggaacggtatacaccggaagaagccatggaaatgatctacaaaggtgaaatcaaggatgcaaagaccgttgcggcaatttttgcgtatatgaccagacataaataa

SEQ ID NO: 3114 - DNA, 1581 bp, Clostridium sp.
atgaaacgccgatccaaaagctttgaatttcattttacaatgatattatatgatctgttcaaaaccattctggtttttctgatcgccactacattcgcgttatgtctccaggaagcggacgtcatgaatgacaacatctttggggtttatatgctggcggttgccatcacctcctccatcaccagcggttatttttgggggattgtggcatctttctgcggtgtcgttggggttaacttcttcttcaccttcccctattttgcactgaacttcaccttggctggctaccctgtcacattcggcatcctgcttttgatgtccatactgaccagcgcattgacagccaaagtcaaacaggctgccatcctgtcctctattcgagaaaaacgtgcagaaagcctgaactccatgagcaaagcattgctcagcgcaaacaacattgatgaaatcatgcagatcaccattgacagtgtatacgctgccaaccagtgcagtgcggtgctgtacattggttctcctgtttcacccaaaaaaaaggtcacaaaatatgtgaacgaaaaagacgaattgattctggaaagtattttggaacaacaggtagcggaacaggcattccagaaaggcgaaatgactggtctaggcacagaaaaaacatcccaaaactgtcttggcacctacattcccttttccaataaagatagaatctatggtgttttggggcttttgttctccaaaaacggttatattgaaaatgacgctttacagttcgccaacttcatgacatctcagaccattttggccattgaccgtcaggaaatcgttgacgaatctcagaaaatcttattggaaaaagaaaaagaaaacatgcggagcaatctgctgcgtgccatctcccacgacctgcggacaccattgacctgtatcctcggttccacagccactttgatggaaaaccgctccatgcttcaggaggacgtctgtgaccgtctgctcagtgacattcatcatgacgcggaatggctcattcagatggtagaaaacctgctgtctgtcacaaagatcagcggcgaaggcacaaagctgaaaaaacaggaagaagtggtagaagaaatcgtagcggaatctgtcgcaaaaatccaaaaacgttttccttcttcacaaatccgtgttcgtgtaccggacgagctgcttttggttcccatggatgctatgctcatcgagcaggtactcatcaatttgatggaaaacgctattcgccattccggcacagcaaaacctatttatctgacagtaaaacatttatggcatcacgtttatttctctgtactggatcaggggatcggtattgaggaagaacgcctgccgcatatttttgacggcaccaccagcagcaaatcttcggattcttcccgtggcctgggcatcgggctgcccatctgtaagaccatcatttctgcccatggcggtgaaatctacgcaaagaacaacgagaacggcggtgcgaattttacctttgtactgcccatgaaaggagaagttgagcatgtccaacaaactgaagatactggttgtagaagatga

SEQ ID NO: 3115 - DNA, 870 bp, Clostridium sp.
atggaagcaataaataaagaatcagctttacagagactgaaaagctatcgcaaacatccgctttccgcaatcctgtttttactggttgtgatttcagcggtgattacattaaccgtattgattgcactgattgcttatattctgattaaagggattcccaatctgagtcctgaactttttgaatgggaatatacaactgagaacgtttctatgatgccggcaatcatcaatacactgattattacagcattatctttgctgtttgcactgccagtaggtatttgctccgccatttacctggtagaatatgcaaaacgtgggaataagctagtttccattgtgcgtattacaacagaaacactgtcaggtattccttccattgtatatggtttgtttggttatctgttctttaatatcttcctggaatggagctataccattctgggtggtgcgctgacactggcaatcatgattttgcctttgattatgcgtacaacagaagaagccctcattgcggtgcctgacttgtatcgtgaaggcagtttcggtctgggtgcaggcaagctgcgtaccgtattccgtattgtacttccttctgcgattcctgggattctggcaggtgtcatcctggcagtcggcagaatcgtcggtgaaacagctgcactgctgtatcccgcaggtacagccacaaaggttgcggatggtctcatgtcctccggccgtacactggcagttcatatgtacgcactgctgaatgaaggtctgtacatggatcaggcgtatgcaacagcggtcgtactgcttgtagttgttatcggtatcaatgctttgtctggattgattgcgaaaaaggtaggagtgaaagattga

SEQ ID NO: 3116 - DNA, 1365 bp, Clostridium sp.
atgaatgcttcagatcgcactgccattttcgaaacgttgcctgttcaccaggctgtatataaacaaatcattcctgcgattgtcagtcaaatgattgcactgatatataatttggcagacacttattttgtaggtatactcaatgatcctcatcaaacggccgccatcaccattgccgccccttcatttgttatgctgactgcgatttccaatctgtttggtgtcggaggtgccagtgccattgccagggcattggggaaaaagcagccattacgtgcaaaacagattgcttccgtttctttttggggaggacttatatgcgcatgtatgttttcggttgtctttttccttatggcccgacccattctctttctttgtggagcggcggaagaaacatttgcccttacaatgggatacgcaaaatatgtggttattctgggtggcccatttactgtattgaatacacttcttgcgaacctcattcgagcggatggcagcgccgctttagcctccatcggcgtttctttgggcggtattatcaatatcattctagatccattatttgtattgccacagtttattggtttgggtgctattggtgcaggtatggcaacagcactttctaatgttttagcaacagcatttttccttctttctttatatcgtatgaggaaaagctctgtgatccatattaatcctcaatatctccgttatgccaaattgcatttaaaaagcattttgtccgttggatttccttccgctgtccaatatgctctgactgttgtagccatcgctgcacaagcgaaatttgtatcaaaatatgccacagaagctgttgcagcattaggtatcgttaaaaaattggatcagttgccgctttatttttccattggcgtctctagcggtctgcttcccctattggcttacaattatgcctctggcaaccaaatcagaagacggaaatcttttcgttttggctgtatgatttctttttccttttctatgctctgcctgatctgttatgagttgtttgcaccacagctctcagctctgtttattgaagacgcaacaaccattgcatatagtgctggctttttgcggagaatggtaacagcaatgcccatgatgtccctgtgctatccgatgattatccagtttcaggcaatggggaaagtaaaagaatctctcattacttctgtattgagaaaaggtgttttggatattcccctgctctttttcatggattggctgatgcctctttacgggtgcatgtgggtacagcctattgtggattccatttccttggttgtggcaggaacattgtatttccgtttaaaaggaaaagaaggaacgacgcaaatataa

SEQ ID NO: 3117 - DNA, 453 bp, Clostridium sp.
atgctgagcaaaaacagaaggagagatttgctgcctatgaaaacaaccctgacacaacccctatattccctgccatacagcctccatgatgggtatctgaaaaagctggaagcagacgaagaaacactgatctgccattttcctgacggcattttttccaccaccgccccctatgaacagacagcaggcacaaaggtcatatttacgggcgtggattgggattcttcttttctatatgtctttgacggactgaaaaacacaggtgctttttccggcaaaaaatgggatctaaaggcctttctgccttatttggaacggctggaggtcatagacgaaacatacggctactggcaggcgaaatggaaaggacttctgacaaagggagaagaaatggtggaatgtatggtggaggtttgttacagcggggaaatggtgtatgagatagagaaatga

SEQ ID NO: 3118 - DNA, 1560 bp, Clostridium sp.
atgtcaaagacgaataagaaatcattatttggcagatttcaaaatcttgccattgcaaagagaattaccctgatttatggcgggatattttctttttccttgctgctgctgagtggatttttctttgtgaataccacgattctggagcagaacagcgtgcggaaacagctggagactaccattgtcaacattgagcgtttcttggataatggcggtactctcacagatgaatcgctaaaaaatctgctggataacaaatacgtggaagtcagtgtattcagttattcagaaaatgaaggctttaacagccatgtaggtgaaattccggcattcatcaaacagcctccccagctgatgaatgaaaataacggatcaaattccttatgggatggaatcttgaataaggaagaaatgatagaagaattgccaaagacggagtatcatatccgttctttgaaagaattgggtgtgaaccgtcaggaatttatattagaagggccgggaaatcagaaatttatgctgttgtccactcaatacaaaaaagatggggacaagtatcagattcaggcattcaaacagctcaatggcaatcagtactttatacaatcctttttatggaaaatgatcattgcggatttcatcggcattttctgtgccttccttgcggggcgctatatcagtcgacgggtgctgaagccggtggaacagattcgcacaacagcggaacggatcagtattgaagacctgacccagcgtatcgacttagatgggccagatgacgaaatgaaggaattgaccatcaccttcaactccatgattgaccgactagagaaggcgttccacagacagaatcagtttgtgtctgacgcttctcatgaactgcggacacccatttccgtcatccagggctatgcaagcctcatcaaccgttggggaaagagcaacccagatgtattgcaggaatccattgattccattctgggtgaaacagagcatatgaaagagctcatcaataatctgctgtttttggcaaaaagcgaccagaaccgtatgcatgccaaacggtcacggatgtgtctgaatgatgtggcacaggaaatcgtcaaagaactggatttgcttcagcaggatcgtcagatcacatatgaggaagcggagcaggtggaaatcaacggcgatagtgacctcattaaacagcttttgtggattcatggggaaaatgccctcaaatacaccacaaacggcggcaaaattcatatcaaagtctggaaagataaaaaatatgcttatgtttccgttgctgacgatggcatgggcattgcggaagaagaacagtctaagatctttgaccgtttctaccgggaagacaaatccagaaataaggagatttccggtactggtctgggactttccattgcaaaatggattgtcagcagccatgacggtgccattttggtggaaagcaaacgtggagaaggcgctacatttatcgaccgtttccctttgtgggcagaaccggaagtaaaaaaagaaataggtaagaacggtaaaatcaaataa

SEQ ID NO: 3119 - DNA, 786 bp, Clostridium sp.
atgaatgcaaaggaggcattgtatatgtaccagatcaaaaatcttttggaaaatgacgacattcgtgttttgacagaattggggccttttaccgtcattgaatacctgcgggatttgagtgtttcccccgccaatgcggcaacagcttattttgcttctgaaatgaatgtgcgtagacgtcaggtcatctgtgatttgaaaaaagccaatatcacattgcaggcaggcgctatgcagtggatggtgggcaacgtcaatgccaccacaggcatcaaaggtgttggcgaccttttcgggaaagccatccgtgggaaagcaactggtgaatctgccatcaaacccgaatacaccggcgatggcactttggttctggaacccacttacaaatatattctgctggaagatgtagcagactggaatggttctctgattctggaagatggtctgttccttgcctgcgactccaatttgacacacaaggccgttatgcggtctaatctgtcctctgctgtggctggcggagaaggcttattcaaccttggtttaagcggtaaaggcgttgtagcgctggaatgcccctgccccagagaagaactgattgaaatcaacctccaggatgatgtactgaaaatcgacggcaatatggcaatcgcatggagcggcagcctgaactttaccgtagaacgctccggcaaaacactcattggttccgcagcttccggcgaaggtctggtaaacgtattccgtggaactggcagagtactcatggcacccgttctggactaa

SEQ ID NO: 3120 - DNA, 2259 bp, Clostridium sp.
atgagaaaatctaacgggggaataaaggcaaatggaagatttgcttttattctctttgccttttttgcggcatttgcgctcatgcttggcagagtattgtatatgaaagttgtccatggcgcggagtatgaagcggcagcgaagaaccagcagatcaaccgctacgacattaccattccgccaaacagaggaagcattctggacagaaacaatcaggtgcttgccatcagtaccacggtttacaacgtggcgctggactccttgcagctggcagaggttgcacagcaatatcctgaggaacaggaaaagacattgacaactctttgtgagtatttcccggaactggattacaacacactgaaacagtatgtgactgtcaatccggaaactggagagctttatatgaacaaccactggaagtacctggtgaagggtattgaacgcagtgtgaaagaagaactggaagctatgaacctaaagggcgtatattttgaaaaaagcagtaaacgctcttatcctttgaacagctccgcttgtcatctggttggttttacccgtggtgacgctcagtggggactggaaggctattacaatagctatatggaaggaacaccggggcgttctttcattctttataacggtgcggactccgttgtgcatcaggattatgatgccaaagacggggataccatcatcaccaccatcgattataatatccagaagattgcagaagaagtggtagcggaaacagcggcggaatggcccgccaaaaacgtggcggctatggttatggacccttataccggggaagtatatgccatggcagaatcccactccttcgatttgaataatcccaatgaaattccagaatgggaaacagatacgacttacacagaaaactgggatcagctcagcaatgaggaacagctgaattacctgaataccatgtggaagaacttctgtgtcagcgatacctatgaaccaggttccatctttaaaccgattattgtggcagcaggtttggaagagggtgtcattacaccaaattctagcttccagtgtaatggttatgcggatatcggcggatatcgtatctggtgtcatctgcatagtggtcatggtaatatcaatatcgagcagatcatggctcagtcttgtaatatgggtgttatccagattgcaaatctactgggcgcagataaattctatgaataccagagagaatttggtttcggggattatacaggcattgacctgcctggggaagccacaggtcagctccatgcgaaagaagccattggccccacagaattggcaaccatgtcctttggtcagacattcaactgcaccagcattcaggcaattgcggcattttccgtgttgatcaacggcggtaatctggtgaaaccccatgtggtatctcagattgtggatgcagatgggaatgtggtcatgcaaaacgatacagaagtagtacgccgagttatttccgaaaaaacatccgcttatatgcggacagctctgaaagccacagtagaaaatggtctggcaaagaaattgcagattgatggttactctatcggtagtaaaacaggtaccgcacagcagggttctcgtgcggataataaattgtggacactgagtaatatgtcgtatttccctgcggaaaatcctaaatacattgtgttcactgttatcaaccagcccagtgactatgtggaaggcgtgcagacacctacacctatgaccaaaaagctcattgagggcatcatcaaatacgataatctggaacctacacagccagtggaagatgaggcaaacctgtccaagaataaaaccgttactgtgccagattacactgatagtgtcatctttggcgccatcgaggatctggacgcaagagaactgacttacaaagtggttggcaatggcaatactgttgtgaatcaggtgcccaaaggcggaaccactatggatgtaggcagtgaagtaatcttgtacgtagagcgctcagaagaagatgctggcactgtcagcgtgccgaacgtcgtcggcaagaactatgaacaggcggaaacaactttgacaaatgcgggctttacagtggcatttgaaggggatcaggccggtaccgtaacggcacaggatcccaagtatggcgtatccgtagccaagggaagcgaagtcatgctgacccttgaaattccggaaaaaacggacacatctacggatacaacgggtacacaaacgacacaataa

SEQ ID NO: 3121 - DNA, 1323 bp, Clostridium sp.
atggatctttttgaatataatctccagaaaagaggcacacaggatgcccctcttgccgcaagaatgcgtcctactactttggaggaatttgtggggcaggagcagattgtaggaaaagataaattgctttaccgtgccattaagggtgacagactgggttctttgattttctatggcccgccgggaacagggaaaacgacattggcaaaaatcattgccaataccacaaaaagtgagtttgtccagatcaacgctaccactgccggtatcaaagacatcaaagatacggtgacggcggcaaaagaacgtcttggtatgtttggcaaaaagaccattctttttatcgacgaaatccatcgtttcaataagacacagcaggatacacttctgccccatgtggaggatggtacactggtgcttattggtgccaccacggaaaatccttattttgaagtaaaccgggcgctggtttcccgttctgtgattttttccttggagcccctgcggcagaaggatattgcatctcttttgcggcgtgcgttagcagatgaggaaaaaggtcttggcagctatcatgcaaagatggatgaagatgcattggatttcctttccaatacggcaaacggtgacgcaagagcggcacttaacgctttggaattggctgtgctgacaacagatccggacgatgatggaatgatccatatcacgctttctgtggcggaagattgcatccaaagacgcgcattgcagtatgataaaggcggagacaatcattatgataccatttcggcttttatcaaaagtatgcgggggtctgaccccgacgcggcgctgtattatctggcaaaaatgatttatgctggtgaagatccgaagtttatcgctcgtcgcgtggtcatttgcgcggcggaagatgtgggaaatgccgatcctcacgcgttgcaggtggcagtatcagcgatgcaagcggtgaactttatcggcatgccggaaggtcgaatccctctggcacaagcagtgacttatgtgtcctgtgcgccaaagagcaatgcggcttacttagggattgataaggcgttggcggatgtgcggaatgtgcagatcaaaggggtgccgcctcatctgcgggatggtcattacagcggcagtcatgatctgggcaatgccattggatacaaatatgcccatgattaccccaatcattatgtggagcagcagtatctgccggatgaactggttggaacggtttattatgatatgagcaataatggcgtggaacgccgtatgaaagagcatatgaagcgactgaaaggcgaactgtaa

SEQ ID NO: 3122 - DNA, 1095 bp, Clostridium sp.
atgacaatccaaacagaaaaaggagtggggcctatgaagatgaaaaacatcgttgccatgacaatggcagcaacaatggtatggaacggtacagcggtttttggagcaaccggtgtaaagactgctgtgctcaatgatgctaggatcagttttaacggtggtacgccacaaaccattcagtgctatatgattgaggggtataattatattagagcacgggatgttaccaacaatttgaatatgcatgtgacacagatgcaggatgaaaatacgggcattgtggtacagcctaacatggctgcgtcctctgtcagacccacagaaaaattgacaaaacagtctgctgctgtgaatgtgcagaagggatggctggtatatgatgcaacgccttttgaagcggaatgttttttgctggataatcgtttctatttcaaattgagtgatttccagaaagccagtgatctcagccgggatatttctttggtatgggtggcagcagaagcggcagatcaaggcatcaaagaaccctatccgaatacctattatggtatggaagtttcctgggacgcggaaaatagggttgtgcatgtggatcgggtgaatacagatctgaagaaagtatttgatgatattcgcagcaatcaatctcaggaaaacgaagaaatgcagaagcctgaagaaccgataaaggatagtcagaatcctaaaaatccagaatcccaggaagcggtagcaaaagattctgtggaagccgtattccagttggttaaccaagaaagaaaggcaaatggcagaagggaacttgtacttgatcctacgctttgcgaagccgcacaggtaagagcatccgaactggatacactcttttcacataccagacccagtggggaaagctgtttctctattttagatgagtacggtctgcggtattccggtgcgggagaaaacattacaaaaggacaaagggatgcagaacaagttatggattcctggatgaattctgagggacatagaaataatatcttgtctttggattttacgaaaatcggcattggacatacaggggataactgggtacagttgtttatgaaatga

SEQ ID NO: 3123 - DNA, 1350 bp, Clostridium sp.
atgcctggacacaaacggcagaaacagcagggcagcctgtttccttatgatttagatattacagaaattgatggctttgataatcttcaccatgcggaaggtattctggaggaagccatggaacgagcagcaaaactttggggcagcagaaaaagcttttttctggtaaatggcagtagttccggcttgctggcaggcattcgggctgtgacaaagcgcggtgacaaagttttgatggcaagaggatgccatcgggcggtgtaccatgctgtggaattgtgtggcctgcatcctgtttatatgcaggcggaatgggtggaagaaatgcagatttccggcagcatccagccggaaaccgtagagaagcacttgcaggaacatcctgactgcaagctggtgattcttacaagtcctacctacgaaggcgtggtcagtgatattaccgaaatagcgaaagttgcccatcggtatggtgcatatcttctggtggatgaagcccatggcgcgcatttgggttttagcaaaggattcccggatacgtcagtgcatttgggggcggatgtggtggtacagagtctccataaaactttgccttgccccacccagacagctattttgcatgtctgcacagcacaagtggatgtgacagaggttggaagacagctttctgtattccaaaccagcagtccttcttatgtgttcatggcggaaatcgatggatgcgtttctttattggaacagaaaagagaaagtctttttgcagcttatgaaagaagattggcatctttttatgaaaaaatggagaagctgaaacatatcagactttgtcagccggcagtttctccagcagtgtttggtcatgacaggggaaaactcctcttttttacaggaaacagcaatttgtcaggggtagaactggcagaaattctgcgggagagatatgaactggaaatagaaatgtcgcagcccctgcatacattggcaatgaccagtatttttgatacagacgaaggtatggaacggctggcaaaagctatgctggaaattgacaaagaagtaatgccggcaaaacagccattggcaaaagggcagatggtgcttccgcagatggtatgcggtatggaacaggctttgcggggagaaacgacagaagtaatattggatgatagtcttgggaaaattgcggctgattttctttgggcatatccgccggggattccccttgttgcccctggagaacgaatttcagaagaggtattggctcaggctttttatatgaaggaaaacggtgtcaatgtccagtgcgcttttgcaaaagacggaaagattcgcgtttgtttttgtgaatga

SEQ ID NO: 3124 - DNA, 1059 bp, Clostridium sp.
atgttagactttatgagttttggcgagaatatcgggatcgacctggggacggcaacggttttggtttatatcaagggacagggcatcgtcattcgggaaccttccgtggtagccattgacaaagacagcaattccattcttgcggtgggtgaagaggcaagacgtatgctgggcagaacgccaggcaatatcgttgccattcgtcctttgcgcgaaggtgttatttccaattatgatgtaacagaaaaaatgctgcagtattttattgaaaaagcattgggcaaacgttcttttgtgaagcccaccattgcggtttgtgtacccagcagcgtaacagaagtagaaaaacgcgccgttgaggatgccaccagacaggcaggcgcaagacgtgtgcatattattgaagaacccattgcggcagccattggttccggtattgacatttccagagcatgcggcagtatggtggtagatattggcggcggtaccacagacattgcagttatttccctgggtggcactgttgtaagttattccttgaagattgcgggggataactttgatgacgccatcattcgctacatgcgcaaaaaacataacgtgcttattggggaacggacagcggaagaactgaagatcaagattggtaccgcttttgaaagaaccatgccagtgacactggatgttcgcggcagaaacttgattaccggtctgcccaagaatatcaccgtaaccagcgacgaaatgctggaagcgctggaagaatctgtggaagccattgcggaagcagttcacagtgtattggaaaaaacccctcccgaattggcagcggatatttatgaaagaggtattgttatgactggcggcggcagcctgctgtatggtctggataaactgatccagagcagaaccggtatccatgccatggtggcagaggatgcagtcagctgcgtagccatcggtactggcagatatatcgaatttatgtccgataacggccctgatgatgaacgtcccggcgttctttccggtctgctggacaaatttaaaaagaaatga

SEQ ID NO: 3125 - DNA, 1140 bp, Clostridium sp.
atggatatgcaatatgggaagaaaggagcatatatgattagagcgtatgacagaaaattaattatagaagatggcagccaatactatggttatggctttggcgcagatacagacaaagtatttgagttggtgttccatacaggcgtcattgggtatcaggaaattttttctgatccgtcttatacctatcagggggttgtgatgacatatcctttgattgggaattatggcatggcagcagatgattacgaaacatttcatccaaccattggtgccatgattgtgcgggaatatgaagatcatccttccaatttccgtgcggaagcaacgctgtctgaaatgatgaaaaagtttgatgtgccgggtatttccggcattgataccagaaaacttacaagatctattcgagattttggcagcagaaaggcattgcttaccagcgtaaatacacctttagaacaaggtttggaaattctgaagaaaacagtgattcccgggaatatggcggaagtcgtaagctgtaaagaaagctgggaatatgaaacagaagaaacaaaatatcatattgcggctgttgatttcggtatcaaacacagcattttgaaagcatggaaaaagagaggctgttatgtgaccattgttccttggaatacatctgctgaggagattcgaaaacttcagccggacggtgttttcctttccaatgggccgggagatcctgctgcggtacagcctgccattgaaatgattcagcagctgcggggaagtgtgccgatgtttggcatttgcctgggacatcagctcattgcgctttcttatggtgctaagacatacaaaatgaaatttggtcaccatggcggcaaccacgctgtgaaaaatctggaaacaggcaaaatcgagataacttctcagaaccattcttatgcagtggatgaaagcagtctggaagaaaccgatttgaccattacccatatcaatctgctggataaaacagtagagggtgtggcttgcgaaaaagatcgtatttacagcgtacagtatcatccggaaagcgcgcctggcccacaggacagcggttatttgtttgatcgttttatacagatgatgaaggagggaaaggcacatgccgaaaagaactga

SEQ ID NO: 3126 - DNA, 2745 bp, Hungatella hathewayi
atgaatgtacggatacgaaaagggagcattcaaagggataaaaggaggaaggatgaagtgggatatcagtttgtgaatcaggaaggcgatttcgtgttggcggaaccggagcagagtaccggtctctatctgccgttggtaaatccggccggagtcatgggggccattaccccaaccggccatggggacagcaagttatcacaggatcagttcctgctggaaccggctggtgcagaagatctgcacagccaggcgccggccaggaacttctggtgtctgacagaagggcacggcccctggtccgtgttcggtcagtctgcggaacaggaggcgcggcgtttcagcggacacaaagacctcagcgaactggaggcaggcgctttctggcagaaagtgaaacgaaaatgccaggacagcgggctggcggcggaagtactttctttctgtcctgtagatgattctgaagcagccggtgcccgggcagaggtgatgaaggtcacactgaaaaatgaaggaagcagggaactcacggttcgtccggtggcggcggtcagcctctacgggcgcggagccgaccatatcagagatcaccgccatgtgacctctctgttaaatcgtatgacggtcacggctgacgggattgtgctgaagccatccatggcttttgatgagcgggggcatcatcaaaatgagatgagctacggcgtgttcggaaggcgggaggatggagcacggcctgacggctttatccccgtgtcagcggatttcatgggcgaaggcggaagccttttatggccccgtgcgcttgctgatgaaaagatgtccgatcatgaggtctggaagaaaccgggttacagtacggagggatacgaatgcgcaggcgttatacggtttgaagagatgacgctgaagccgggggcgtcatgcagcttttatctggtgctcagctatatggaagagggaaaggagtacctggagaaggaaaaggcggaagccgcgtttgagtcgatgaagcggtattggaatatgcagaaaatcgcagggtgcagtacggggaatcagacttttgaccggtggatgcagtgggtatccctgcagcctgaattaagaagaatctacggctgttctttcctgcctcatcacgattacggaaggggcgggagaggctggagggatctgtggcaggactgcctcgccctgatccttaagaatcccgccgccgtgagggaagatatggcggcatttttcgccggaatcagaccggatggcagcaatgccaccatcatcggaagcggcagggggactttcaaggccgaccgaaacgcaattgtgagaatgtggatggaccatggctactggccttaccggacggtgcgcctctatctggacgcgacgggggatgtcgagttcctgtttgagaagaatacctattttgtggacggagtcagaaccagagcaggaggccgggagaaggggagtgcgggagaggaaggcagagaagcgtatcggggaacgcttctggaacacttgctggttcagcatctgacccagttttatgacgtgggactccacggccatatgcggctgcgaggcgcagactggaacgacgcccttgacatggcgggggaaaatggggaaagtgtggccttcacagcggcctacagcggtaatttaagagaattggcggaactgatcacctggctcagagaggaaaaaggcgtagctgcggtggaagtggcggaagaactggggacactgctttgcgcggacagggaactgtatgacaggccgcatggaaagcaggaattgctgggagcctactgtgaacgctgtcttcatggcttctgcggcagaaccgtgacggtcgatacgggacggctgtccgggattctcgatgccatgggagcgtggatccagcagcacatccgtctcacggagaccataaaggacggggaagataacctctggtttaacgggtactacgacaatcacggtatgcaggcggagggcgtatttgaagaaaacgtgagaatgatgctgaccagtcaggtcttttccatactctcgggaaccgcaaccgatgagcaggtggagcggatcgtcggtgcggcggaccgctatctgtatgaaaaaagcgcgggcggctaccggctgaataccgattttaaggaagtaaagctggatctgggacgaatgttcggtttcgcctatggccataaggaaaatggagccgtcttctgccatatggcggtgatgtacgcctatgccctgtaccggaggagatttgccagggaggggtatcgggttatcgaaagcctgtacgggcaatgcatggattttgagacctccaggctctatcccggtatcccggagtattttaacgagaggggcaggggcatgtacccctggcttacgggggcggggagctggctcatcctgacccttctgacccagatcttcggcgcggaaggggagtacgggagtctgacgctccatccgcagcttctggcggaacagtttgaccgggagggaaatgcccggattgcattttcctttgcaggcaggaagatgaatctgatttaccagaatccgaaacacctggaggtgggcgactacgaggtggtggagatctgcctggacggcaggccgctgccatttgataaaaagaacccggtggtttcccgggaaacactgctgcggcttcctggtgaccccgtacatactctgcgagtcacgctggaatga

SEQ ID NO: 3127 - DNA, 2145 bp, Hungatella hathewayi
atgccaaacattacgctactggatcaaaataccataaataagattgcagcgggcgaggtgatcgagaggccggcctctgttgtgaaggagcttttagagaacgccatcgacgccagggctacggctgtgacggttgaaataaaggaggggggcaccaccttcatccgcgtgaccgacaacggctgcggaattccgagggaagaggttccgctggcgtttctgcgccactccaccagcaagatcaagtccgtggaagatctctttacgatctcatctctgggctttcgcggtgaggccctcgcaagtatcgcttccgtctgccaggtggagctgatcacgaagaccagcgaagccctgacgggaagccgctacagcatcgaaggcggcattgaacggccgctggaggagatcggcgccccggagggcaccacatttatcgccagaaacttattctttaacacgccggccagaaggaaatttttaaagactcccatgacagagggctcccatgtggccgagctggtggaaaagatcgcgctctcccatccggagatttcgatccgttttatccagaataaccagaacaagctgcatacctccggcaaccacaacttaaaggacatcatctatacggtcttcggcagggagattgcggcgaatctgctggcagttgaggcgaagaagcaggatatcgccatcagcggctttatcgggaagcctgtgatcgccaggggcaacagaaactacgaaaattatttcatcaatgggcggtatatcagaagcagcatcatatcgaaggccatagaagaggcctacaagccgtttatgatgcagcacaagtatccgtttaccatgctccatttcaccattgagccggagcttctggatgtcaacgtccatcccaccaagatggagcttcgcttccgcgacggggagatggtgtaccgtatggtctacgacgccgtatcgggggcactcgctcacaaggagctgattccggaggtggaactgaataaggaaaaggcggagcaggaggcaaaagaggcgaggaagcacgagccgtcaccggagccctttgagcttcgcaggctggaggccatgagccggcagcaggccgcctgcgcgcctggctccaaacggcttaagccggcagaaccgtctctcatgagagatcctgattttctggctgaaaactggctgaagaagccggctggcgcagactttttacacgggttaccggaatcggctgcgaaaaatgaagaaacggtacaaaatcaggcagatggtgcaagggaacatggacaattaaacggaatgacggaccgtggagtgcagcccggagagggagaggcagcagcgagagatgcggcagcggaagaggcagcagcgagagatgcagcagtggaagaggcagcagcgagagatgcggcagcggaagaggcagcagcgagagatgcagcagcaagagaggctgcagcgggtgaagctcaggcaggtgcagccgcattttccgggaagccggaacagctggatctctttgacggaaagctgctggaaccgaaatcaaggctgatgcataagctgatcggccaggtgttcgacacctactggctggtggagtttaacgaacagctttacattattgaccagcatgcggcccatgaaaaggttttatatgagaaaactatggcaacacttaaaaacagggaatactcatcgcagatgcttaatccgccgatcattctgaccctgaacatgaacgaggaggtgctgttaaaagagcacatgaagtatttctcggacatgggcttcgagatcgaaccgtttggcggcagggagtatgcggtgagaggcgtaccggctaacttgctgtctatcgccaagaaggatttgctgatcgagatgatcgacgggctttccgacgatgtttcgactcataatccggatatcatctatgagcgggtagcgaccatgtcctgcaaggctgcggtcaaaggcggcagccggctgtcgacggaagaggccaacgaactgatagaccagctcctgaatctggagaatccgtatgcgtgtccccatggacggccgacgatcatctccatgagcaggtacgagctggagaaaaaattcaagaggatagtatga

SEQ ID NO: 3128 - DNA, 1677 bp, Hungatella hathewayi
atggaacaacagaaaaaaacgggatctgaggtaaaaagacgggataacagcagaatatggctggtgctgatcctgctgttgttttttattacactgataacctccagtctggtgggatacatattaggcagcaatgccggaccgtcttctatgggacagctgatcgatacgatcttactgacgccggagagtacggacagccgtacaatgattcatctctccggtattgtggcatacacggatggcacaccggcagcagggcggcgtctcgaactgcacagtgatccgattacaaccgtatcagactcaaaaggcggttttttatttcccaatgtaccgcagggagagcataccatatccattctcaccgatgagggagaagtacaggtacagagaaagatcaatatccagtatgacagcaggaaagagaaagacgtgtccatccaattgacggaaaatggagcatatgcgattgaactatccattgatgtacgagtgctggaagtagtaattgagctggatcaggagagtatgaggattgattcagaaagctttaccttctccactcgtgacggagacgttgtcacacccacgggaagcgcaaatgtcagagatggtgtgatcgtgactccgggaggcaacgtgcatctgcccgatgggaacgtagtatttccgggaggtaagacggatgacaccgcctatattatactctcagatgacactgtgatagaaaaacagccgatagcgtccggtgatattaaggtggacgccgatggagcggtaagtctgcctgacggaacagtgattgagcctggaggaaagattataaatccggatggaactgcagagcttccgggtgcatcgggcgtcgttgttggagacggaattgtcagtcctatcggcagcggaacttcgaagcagccggaaacggaaagtgaggctggaagtgatacgtctgccccatcctccgaagaaattgggagaccgggagcgtcagaccgttttccggaaatttcagaatctccggaagaatcttcttcgaaaaatagcgctggtcagtcagatacggaagaacaggagaatccaacaggacccactttcccggcagaccaggtaatgccatcaaagccatccggttccgggaactcatctgattcggatcgtgattctgtaaaacctgagaagccggaagaaccgacgcagcctgatggaggagttcttgatgtttccgggcagacaacagatggatcttatgcgcagtggacgcagaactgtaccattgatttattttccaaccgcaccggcggagagcagaacaaaattgcaccgggatcttccggatactacttattccggctgcagaacacgcggcgtacttcgctgaacgcaacggtaaccatgtcagaaggagatggacttcatcttccgctttccttcacgctgaccccactggataacgctggaaataagcagacgaagcggtcggtttccggtactctgcaaaggaacggcacagatctgaggttaaacacggaaatatacgctgaatcgagtgaactataccggttggactggatctggccgccggaaggaaatgacagcgaggatacccgtatcggcagcggtacggaacatacctatatactgaatatgaaaattcatgcggaggaaagctga

SEQ ID NO: 3129 - DNA, 1956 bp, Hungatella hathewayi
atgaagaaaagaagattgactgcggcactgctctgtgctgttcttgctgcttcgaccgtgctcagcggatgcggcggtaaaaagacgacagaaggcggaagtaccgcccaggctggtaaggaagcagggaaaaatgagaatgggaaggacggagacaatggaaaaccagtcgtatataaggaactgtattcgggggaggtcgcgactttaaattatttagtttcgtcttcagacaacgatatcagaacagcggcatactgtattgatactctgatcgagtatgacagctctggtcagatcaggccgggacaggcgacggaatgggaatatgacgaggcgtctaagacgtggacctttcacttaagagaagctaaatgggtggataacacaggaacgcctgtagccgatgtgacggcacaggattatgtggacgccatcaaataccagttgacaccggaatacgagagcgggattgtgcagaatctgttcggtgtgattgcaaatgccagggcgtattacaacggccttgtttataacggcggagctgatgatgagggggtggtatggaatgccattgatttctctgaggtcggtgtaaaggctgtggatgatcatacgcttacgtatacgctggagacggaagtgccgtatttcatatcttctttggcttatattgtttatatgccggcttatggacctcaactggaggagttggggaaggagtttgcaacaggcgcggataagatgtattacaatggctcttactatatgtcggagttttctcctcaggagcgccgggtgtataaaaagaatacgttaaactacgacgcggatattgtctatattgacgagatacagaaaatttacaatgcggaagcgtttaccatcggaccggagatggtaaagcgcggtgagatcgatcatgtagaaatcacggctgacattctggatgactggctgagccatgaggatacaaagaatctgatcagccgtgagaggccgagaaacagctattcctatttctactgtttcaactttgatccgcagttcgacgcagagtatgagccggataactggagaaaggccgtgaacaatgagaacttccgtaaggccctttcttccgctctgaataagactaaggaagtagctgtgctggagccgaacgttccggaagattacgtgatcaataccatcactccggcgaagtttaccttcaacgcggatggaaccgattttacagagatcggcgatatggcggctctgggagatacctttaatgaggcgaaggccgtggagtaccgtgatctggcaaagagtgagctggcggccgaaggcgtgaccttcccggtgaaggtgcttctgccgtacaatcctaccgaggtcaactgggataaggagtgtcaggttgtggaacagcagatggaatcgctgctgggaactgatttcatcgatattatcgtgcagacaggtccaaccgacggattcctgactgagatccgccgtaacggaaagtacgcaatgttaaagtgtaactggggcgctgattatgcggacccggagacatggaccgatccattctaccaggcgaaaggcgagagcggctacgatctgggctataagtatgcaaaccttgcgaaagccattgaggatggaaccccttctgccgacgctgtattagagtattttacaacgattgaggaagccaaggacatcaaggtggatatcaatgcccgttacgaggcatttgccaaagcggaggccactctgattaatcatgcgcttgtcgtgcctttcagtatcagcgtaagcaaatatcttgcgacaaagctcaatgtgtttgaaggccagtatgcgccgtttggtgtgtccaacttaaagtataagggccagcatttgcaggatcattacatctccatggaagaatttgaagcgaataaggagaaggcaggccagtag

SEQ ID NO: 3130 - DNA, 2058 bp, Hungatella hathewayi
atgaaagtatccaattacatctcccaaaaacttgtggattttggtatcacacaggtatttaccgtgaccggaggcggagcgatgcacttaaatgatgcactggggcatcaggagggacttacctgcctttataatcatcacgagcaggcatgcgccatcgcggcagagtgttatgcgcgggttcagggacgcatagcagctgtctgtgttacgacaggcccggggggcaccaatgccatcaccggggttgtagggggatggctggactccatacccatgctggtattatccggacaggttcgatacgacacgacggcaaggtggtcgggagtgggaatcagagccatgggagaccaggagtttgacatcacgaaggcgatcgactgtatgacaaagtacagcgagatggtcatcgaccccatgagaattcgctactgcctggagaaggccatctatctggcctattccggccgcccgggtccggcgtggcttgacattccgctgaacgttcagggcgcttatattgagacagaggaactgatcggtttctcaccggaagattatgaagcgggaggcgatggctgggccgtgccttccgattgtcacggtgattcgtgcggtgagcgtgtgagcgattgtccaaagatagaggccgacaatgcggggcagggcgagaagcgtcaggtgcttccgccatccgtaacgcgggaaacggcaagagaaattattaaaaagattaaaaactccgaacggcctgttatcaacgcaggaaatggaatccgaatcggacatgcctttgatgtcttttccagagtcgtggaaaagcttggcgttcctgtcgtgaccggctgggacagcgaggactgtatgcctgatgatcacccgctctacacgggccgcggcggcggtatgggagaccgcgcgggcaattttgccatacagaacagtgacctggttttatctctcggaagccgcttaagcatccgccaggtgggatataattacagtacatgggcgagagctgcctataccattgtcaacgacattgatccggaagagctgaagaagccatccgttcacatcgacatggcggtccatgcggatgtgaaggatttgctggaacagctggagctggttctggatgaagagtacggagccggacagcctgtgtttaccggcggcaccggacttaaagacagaacatggacggagacctgccgcatgtggaaggagaaatatccggttgtccttccgaagcattttgaccacggggaagacgaagacgccaatgtctatgcgttcatgaaggaaatgagcaaccgtctgaatgaagaacaggtgatcgttgtaggcaacggttccgcctgcgttgtcggcgggcatgcgtgtatcataaagaaggggcagcggtttatctcgaactcagccatcgcctccatgggatacgatttgccggcggccatcggggcctgtatggccgtgcaggaaggctatgtgcaggaaaacggtgcgcaggaaggccgtatgcaggaacgggatgcgcaggaaggccacatgcagcaccccgtatcgcagctcaccggcagcgatattatcctggtcaccggcgacggcagcattcagatgaatcttcaggagcttcagacgatcattcatcaccggatgccgatcaagatctttttgatcaacaatggcggctaccattcgatccggcagacgcagaaaaatttcttcggcgagccgttggtgggaatcggtgtggacagccacgacttaagcttcccggatatggagaagctggcgggcgcctacggttatccttactgcagggcatgccataacggagaactggtgccggccattgagacagccctccggacggacggtcctgtgatctgtgagatctttgtgagccgcgatcagaattttgaaccgaaatcagccgcgaaacgccttcccgacggaaccatggtgtctccgccgctggaagatttgtctccattccttccggatgaggagatggatgagaatatgatgattccgcggatcagggaatga

SEQ ID NO: 3131 - DNA, 2352 bp, Hungatella hathewayi
atgacaaatggaatcaaagatcatataaaagttctggtaaaatccatgactctggaagaaaaggcgcttctgtgctccggaaagaatttctggcagctggaaggtattgaacgtctggatattccctccatcatggtaaccgacggccctcacggtctgcgcaagcaggccggtgaggcggatcacctggggctgaaccagagcgtaaaggccacctgttttccgcctgcggttacctcggccagcagctgggatgaagctgctctgtatgaaatggggcaggccatcggagaggagtgtgttcaggaggaggttgcggttattttaggaccgggaaccaacatcaagcgttctccgctctgcggccgtaattttgagtatttcagcgaagacccgtatctggccggcgagatggcagctgcctggattaacggtgttcagagccagggaatcggaacgtctctcaagcattttgcagccaacaatcaggaaaaggccaggcttgtcagcaattcggtggtggacgagcgggcgctcagagaaatctatctggccccgtttgaaaaggcggtaaaacaggcgcagccgtggaccgtgatgtgttcctataaccggattaacgatgtgtactcctgtgaaaatgagtggctgctgacggaggttcttcggaaagagtggggctttgaggggctggtcatgactgactggggcgccatgaatgacagggtgaaagcactgaaagccggccttgagcttgaaatgccaggaccggatccccataatgataagaaaattgccgatgcagtgagaaatggagagctggatgaagcggtattagaccgcgcggcagagcgtctccttaccatgatcaggaaagcctgtgaggtccgcaaaaaagagtacgacgcggcggcacaccataagcttgcaaggcggattgcggcagaatccgcagtactgctcaaaaatgacggaatgcttccgctcaagaaagacggttcctatgcggtgatcggcgcatttgccgaagcgcccagatatcagggcgccggaagctcaaagatcaatccccatcaggtcgattgtgtgctggattctctccgcgaaaatggcattgcatttgaatatgcacctggttatgagctggaacatgataccatcaatcagacgctgatggaagaggcagccgcctgtgccaaggggcgggatggtgtcatcgtatttgccggactgccggattcctatgagagtgagggctttgaccggacgcatttgaatatgccggagtcccatacagcgctgatcgaggcggtagctgcggtaaatccccatgtaacggtcgttctcctctgcggctccgtcgtcctaatgccatggagagagcgggtggagagtattttactcgcctgtctgggcggagaggcggcgggaagcgcctgcgcagatgtgctgaccggagcggtgaatccttccggccgcctggcggagacgtttccgctttcactggaagataccccgtgttatgagcatttcgcaggagaaggaaaggacgtggaataccgcgaaagtatttttgtcggctaccgttactacgactgggctgaaaaaccggtagcctatccatttggatacggactgtcgtatacgaccttctcttacgataccatggaccttatatgggatgaagaggcagagatgggcgaggccagaattacagtgaccaatacgggtaaaaccgccggcggtgaagtggttcagctctatatcggcaaaaaacagtcggctgtgatgcgagctgtcagagaactgaagggctttaaaaaagtgttcctgcagccgggagaatcgcaggaagtggtaatcggcctggacaagagaagtttttccatttacgatacggacctcttcggctgggcagttgaagcgggcacgtatcagatctatgcggcgtcctcctgccgtgagttaagactcagcaaggagctgaaccttcaggggatgcagctttccggcatacccggatatgatgtcagcgaagtcgtaaaggacggccgtttctcggcagacagagagcagtttaagcgcctgtttaagggagaactccccttaacgccggccgccagcagaattacactgaatacaaccgtaaaagaagctttggcaagcgaaaaaggaaaagccctgctgggcggtcttgtcgagggatactcggcccagtatgcaggcgaagacgacatcagccgcatgatgctgtccatgctttttgacatgcctctgcggagcctggcgatgtttggggcggtaaagattgagacgctggaagagattgtggaggagattgagagagggtaa

SEQ ID NO: 3132 - DNA, 1782 bp, Hungatella hathewayi
atgaaatttgtgaagaataaaatcatgaatctgtctatccgaaacaagatgattttatcctacattttaattgcactcatccctttctgtattttcgggatcgtggtcatcagcatttttgccggacaggcggaaaatgatatctcggagcacacgggccagatgatcagccaggtgagaacctccatcgatgtctatatcagcagtattgaaaaaatctccaactatgtgatcgaagagctgagaagcgtggatttcaatgagatgtatacggaagacgacatattctggatgcaggagagctcaaaggcagtcgccaggctgaagcatgtggccaatacccatccggaggtggcaggaattctgtttgccacggagaatgacctgtatatcagcacggggatgacccgtatctccagggattccttcgtgaatgaggagtggtacaggctggcggtcagcaatccggacaccgtctgtctgatcagcgacacgtcgggccgcaatattgtgaccaatgaaagctacagcattgacaatgtattttccatggtgaaggcaatctataaggaaggaaccacggaggtcatgggcgtgctgctcatggatatcaagcacgatatcatttcccagtccatcgacaatattacgatcggacagaaggggtttgtattcgtgatcgattcggaggaccgtgtggtctacaccccggccaatcccattacctaccgggtgaatcccgactggatccggaaggaaaatgctcctgtgaccgccagaatacggggagaaaagtaccagatccgcagcgaacgttcggattacacgggctggcgtgtggtcggggtattctccatcgacgagattatggggcacatgaatacgctgattttcgcgcttacctgcggattgcttctgcttctggtgtttgtctttgtgattacggtgaagatatcccagacgatcacgaatccggtggtggagctggagcagctgatgaaaaaggcggagtccggggatctggccgtccgctttcagggagattaccatgatgaggtcagcgagctggggcgtgattttaaccatatgcttgtgcggatcgaggacctgatccagcaggtatacatcgagcagaagaacaagcggatggcggagctgaaggtactccaggaacagatcaagcctcatttcctgtacaataccctggacaccataagctggatggccagggattacggggccggggatgtggtgcggctggtggatgcgctgaccaatatgttccggatcgggctgagccgcggcagggactatatcagcgtggagcaggagctttcctatgtggccaactatctgtatatccagaagatccgctacggcggcaagctgaattaccagatcgtcaaggatgaggaaatcttaaatgaggaggttcccaagctgatgctccagccgctggtggagaatggaatctaccatgggatcaagaccaggaggggggaagggcatctcaccatccgggccgtgaaaactgcggatgggctgctggagttctccgtggaggacgacggatcaggcatgagcgcacagcaggcggaggaactgaaccatctgttaaatgaaccctgcgagctggaggagcggcagagcttcggactgttctatatcaaggaacggctgcggatcaagtacggagacggatttaaaatccgggtcaacagcatcgagaatgtgggaacaaaggttgtgatccatattccgatccaggaagacggtgtatag

SEQ ID NO: 3133 - DNA, 2838 bp, Hungatella hathewayi
acaggtgtaaacagtatggatttcaacgaaagaaagaaacaaagcaattcctgttcgccgcagacggcaggcggaacatgtccagaaaggaaatatccagcagggaaatgtccagaaggaatggatttcatgaaagtcagcgttatttgctgtttgatggatgaccctctcacattcttatggggaaactccagctttttccgccttacaggttatacaatggaagaatttttgagtctcttcccgagcctgcaggaatactatattcagtttcctgatgattttgcagcgatccgtcgtgaggcggagcaggcagtgaaagccggaagatctgatatcgatatgaccatccggctgccccggcagacagatggttattcctgggtgcgccttctggggtcagtaatcgctgatccggcggcagagggaccggtactccaaatggaattagccgatatcagtgctctggctgccgaaaaagaagaacaggcccggttgtgtgaacagaagcagcactgctttcgatcggtgctggatacctacgaaggcaatgcttatgtcagtgatatcgacacctatgagcttctttatctgaaccagacctcctgcgaggtgcttggcatgccggcctcaaaagtgttgggccaaaagtgctatgagatcattcagggccggacctccccctgtcccttctgtaccaacgacaaactatgcagggaagaattctatcaatgggaattctataatcccactttaggccggacatttatgatcagaaatctggaaattaactgggagggacgccgggcacgcctcgagctctcccatgacaccttcagcgcggaatacaagctggcaaagaaggatcaggagcgggacgcgctgattaacagtgttcacggcggatttgcgcgggtagacgccagagacaggaggacaatcctctggtatggcggcgggttcctcgacctgatcggctatacgaagacagaatttgaacaggagctgcattcccaatgtacctatgtacatccggaggatattgaacagatctccgatatcatggagcagtcacggttcaccggcaggcccacggcggcagaaggacgtatcgtcacctttcatggggttcttaagatattggcgctgtccttcagctttgtcagtgccgaggacagctgggatggcatcccgtcctactacagtgtgggactcgatgtgaccagggaacgcatggagcaggcgcggcagagacaggtgctggaggatgcctgcaagacagcccagattgccaacgaggccaagactaacttcctctcctccatgtctcatgatatccgtacgccgatgaatgccatcataggcatgtccgtcatcgcccaggcaaacttatactctccggaaaagacacaggattgccttacaaaaatcaacacagccagccgccatcttctgaatctgattaatgaggtgctggatatgtctaaaattgaaagcgggaagatcgatctgtcatcggaggaagtctcgctgccaaaattgattgaagatgtgatggatgtattccgtcccctggtcggggaaaaacatcagacgcttcaggtaaatgccaatcgtgtccgccatgaaaaggtggtgacagacggcggccgcctgcagcaggtgcttgtcaatcttctgtccaatgccatcaaatatacgccggaaggcggaaccatcggactgcgaatccaggaaacgccctcttttgcaaagggaaagggacagtattccttcgtcgtaaccgactcgggaatcggtatgaatgaagactttatcccgcatctctttgagcccttcacccgggcggacgacgccagcattcacaatatccagggcaccggcctcggcatggcaattacccagaacatcgtccgcatgatgaatggcaccattgaggtaaaaagtactccggggaaaggcagccagtttatcgttgccgttacctttgatttatgcggagagccagagacagatgatgcagaactggccgggctgccggttttggtcgtggatgatgatcagatcctgtgcgaaagtgtttccgaaattctgaacgatctgggtatgcagtgcagctgggtgctgtccggaagggaagccgtcgaccgtgtcgccgcggctcatgaagcggcggcggatttctttgctgtaatcctggactggatcatgcccgatatcgacggtctggagaccttaaaacgaatacgaaaaaaggttggcatcgacatgccgattatcatcgtatccgcctatgacttctctgaaatcgaggataaattccgtctggcgggcgcagatgccttcatcacaaagccgctgtttaaatcaaaaatggtacataccttccataaattttgcagaattgaccgttccgacgcccggagcgccctgcgtgagaggtcagatgccgccttggacggtaagaagctcctgctggcagaggataatgaactcaatcgtgaaatcgcagtcgaactgctggaaacacacggcctcctgatcgatacggcggaaaatggttccatcgcagtcaacaaatttgaagcctccgctcccggagagtatgccggtattctgatggatatacaaatgccagtgatggatggatacaaggcaacgaaaatgatccggtcactggaacgggaggatgcccgcaccattccaattcttgccctgacggccaatgcattcgcctccgacatcggaaaggctcacagcgcgggaatgaacgaccatattgccaagcccatcgatatcgaaattcttatggaaattctgcggcggtggattggttag

SEQ ID NO: 3134 - DNA, 1944 bp, Hungatella hathewayi
atgaaatccattcaaacgaataagaataaacttctcaggacaaacctgctgatcagcataatcctgattgccggatttgttactacggctgttttcagctaccgggcaaactatcaggtgtctttgaacaacatcgaacaggtctcttcactatccacggaggggatctactatcagttatcctccctgttttccaagccggttaatatatcactgacgatggctcacgacagcttgctggtcgagcatttaatgaaagagccgtctcatctggatgacaaggcctatgaggagacaacaaaagagtacttaaagacctatcgggaaaaatacggttttgattcagtctttctggtttcgactgtttccggaaggtattataactttaatggggttgaccgtgtaatggaacgggataatccggaaaatacctggtattttgatatgctggacagcaataaggagtattcgctgaatgtggacaatgacgaagtgagcggtgcggacaataagatcacgacatttgtaaactgcaggatacaggacacaaacggcgcggtaatcggcatcgtcggcgttggaatccggatggactatattaaggaactgcttcagaattacgaagatacttacaacgtcaaagccaatctgatcaatgaaaacggcgagatagagatttccacctcctataccgggtacgaggcggccgactggtttgagatttacggtcaggagggcatccgggatcaggttcttagctggtatgaggatacaaaaaacctggaactctggacagacaccggtacagaggaaaaagaaaagagctttgtggtaagccggtatataccggaactgtcgtggatgctgattgtggaacaggataccggaaggattatacatgagatgtatatgcagctctataagacgtgtttcgttcttgcgctggttgtcattgccatcctggtcattatcacgtctgttatccgcaaattcaacctgcagattacaaagctggtggaggaacggcaggcaatgtttaaggaggcgacagaacagctttatgaaagcatctacgaactgaatcttaccaaaaactgctatgtgggaaaaacaacagaagattacttttcgaatcttggcgcaggcggtgtcccgtttgaccagggcctgcgaatcatcgctgaaaagcagattaaagaggaataccgaaaaggttacatagagatgttttccccgaaaaatgcgatcagggaatacgaggccgggaacaatcatttaagctatgattttctgtttacactggatggatccgattaccattggatgcgtgtggagacctatctgttttattccgaggaagaccgcagtgtgcatatgttttcctaccggaaaaatatcgaccaggaaaagaaaaaagagctgatggcacagacagacgaaatgactggatttcttaccaagacggccacggagcgtctgatcgagaaacagctgatagaaaagaaggaggagaaatacgcattttttatctgtgatatcgataatttcaagcaggtgaacgaccagttcggccatgccttcggggattactgcatctgcagttttaccaaagccatacgggaacattttcgaaaggatgatattctcggcagaatcggcggcgatgaatttgttgtcttcattccatactcgagtgtaagctggctggaagagaaagcagctgaattatcgaaagcgctggagatggtttgtacgaaagagcagtcaagctgccaggtgtcggccagcatcgggatttcgatatcttcacaggcggggagccggtttgatcagctttatcaaagtgcagatgccgcactgtatcagacgaagaagaatgggaaaaacggatttaccatcatggagcttacaggagagaaagtagcggacagtacagacctgtga

SEQ ID NO: 3135 - DNA, 1500 bp, Hungatella hathewayi
atggcagcgcttatgaggaaaaatttccgtttatggggatatggaaaggcgctggctctttttgccggctgcctgcttttttccatcggcggacgattaaatgaagggatttattatgaacagcatattttatcagcagtatctgaccactactatttgacatactttatgcttccgattctgctgctttgcagtttttcttttttggaagatgatgaagaaactgtgattttacgttttcagagctatcattcttattttttaaaaaaatggctgggagcagggctgagtgcttttttactggctgctgttcaaagtgcagcgattctcttatccggcataggacttccgatgggaaattggtgggagttatcttcaggatcaaccgtgacagagttgtttttagtgctgcagcagtatttttcaactccgttacaggcattttgggtcttctcactctatcagttttgcggaacctggattatatttgggatctgtatgtggattggacacttttgcggacggaaatggtcaatccggctgattcttgctctttatatgttttcggctttgtggatgaaacttccggttattcagatactgccgcttactggatttaatcatttgctgatcctgcatcataatttaggttcacactgccgtttgacagttacaggtattactttattaataattgccataatcataactgccacggttcggtttgggcggcagggatatagattcttccagaggcggcagatttccggcattgttacctactatatccgtgaattggcgacgaggcagaatgtccggatcctttgcggcgttgtttttataattaccctttacaaagagacaggacagctccagggaaaatccgggcaggagtggatctattccttatttgccgggcatggtacaggcggtttccgggtttttgcgttttttgaaatgatgatcacgattggtgcgccgctttatcttctggcggtttttgtggaaaagacagtaagcggtcaatccctttttatttctgtccgcacgaaaagccgtaggacattgatgaggggtatcctgtcgactggtataatatttctcgctgcctatatgcttctgtggtttacagcgggactttctggaacacttttctttagggaaggaacggggatgccagtatggaaaatgctgctgtatgctgtttttttaagattccttgatataatggttcaatattttattatgatgtgtatatatgtattttcaaaacagattacaatcggttttcttgcattgactgcaggaaatctgctctgcattctaccgcagccatgggtatcttatctgccgtttggattatccagcctgacacggattgcggaattaaattccggtattggaatctctgccgcagcggctctgggagtggagactgcctttgcagtgctgctgcttgtatggctcttgatatttggaagcagaaaaatactggattag

SEQ ID NO: 3136 - DNA, 3552 bp, Hungatella hathewayi
atgattaaaataacaaaccaggccaatttaaagtttcaaatgatgtcagataacctccaggtagggatactgaaatgcagagttgacgaatatctttccatcgaagagatgaacgacggttttgttcagttgtcagggtacacggcagaggatatggaacattgttttaagaaccgtctgtcgtcgtgtatttacgaagaggatctatcggtatttcaatccctgcaggcggggatcgcgcagggaaaaatatatgctacggcagaatttcgtattcctggaaaagacggggcagcccgctggtaccgtctgcttgtcctcacacaatttgatgatacgggaaagtcttccagcgccatcgggattatcttcaacatagatgatgaaatgcaggcgatggacaggctgcgttctcaggcacagcaggattctctgaccgggttatacaaccgcaaagaaaccgaaaagcggataaaacagtttctggacagtaagccggagcttcccagcgccctgtttatggttgacatggataacttcaaactgataaacgatacaaaggggcatatggtaggggatgtggtcctgacagaagcggcctgcgccatgaaatctctgatgcgcgcaaccgatatcgtgggccggattggcggcgacgaatttattgtttttatgaaaaacatcccctccggagaggccgccgaaaagaaggcagaacgcctggcagacctgttccgccacatgtttgaacatgaaaaatactcggttcagatatcctgcagcatcggtgtggctgtctatccggaaggcggacgtgattttaaaacactgtacaggcatgccgatcaggccctgtaccacgctaagaccaacggaaaaaataaatatgtcatatataacgataagcagaactatcagcagggaaagccaggagactcttccatcggcgcacgcattgattccgaaacgagaacggctcagggactcggggactttctgactgatatttttaagattctttaccgcatggaaaatccagaccaggcgattaatctgatactggaaatcgtcggcaaaaaatttgatgtgagcagggcttacatatttgaatccaccgaagacggcaaatacacctccaatacttacgaatggtgccatgacggcatttctccgcagatcgatcttctgcagaatttaagttacagccagtttggggattaccacaccttattcgaggatcagtcgatcttctactgccgtgatatcacggcgctgcacccggcacagagagagttattggaagaacaggggatctgttccacactgcagtgcgccttctggaaaggggaagcgcttgcaggcttcattggttttgacgaatgtacaggcctgcgcctctggacggaggaggaagtggatattctgtcgctgatcgctcagatgatgactgtttttctgcagaaacgaagggcgatggactggtacagcgatatggagcatcagctgcatacgattctcgattcggacgattcctgcatttacgtcatcgatcaggattcctttgagttactgtacttaagtcaaaaagccaagaaattaaagcccaacgtacagctgggagaatcctgctatcaggcaatctttgggaaagacaacatctgtgatttctgcccgcttctaaatggaggatcgggattactgaagctccctgaatgcggcacgcaggcagtcttacacgcgtctgccatgaaatggcttggtaatgacgcgtacctcttatccctgcgcacagattccgacgcaataactgctccggaagggaacacctccgccattttgactgaaaaaaacctggcagactgcctccaatggctgacctcctccgtatatcaggaggatgccatagaatacgttctgcgtatcgttcagaattattaccagtctgaccgtgtgtacttaattgaggtagatgtaaaacacaataccgcaaacaatacctatgaaatctgcgcggaaggcgtagccccgcagaaagacatccttcaggatcttccgcttgaaacgatgtccttctggatggaacagtttgcagtcagaggctatatcaaaatcgataatgttgaagaactgggaaaagaccgccatttggaatacgacattctgaaaaagcaggggatcaacagccttatggcgatcccgctgtccggacagggaggcttctgcggattcctgggtgtggatgaccccaaacagaataaaaagaatttccattatctgagagggctatcctattttctcgagagcgaactcgctaaaaatgcgctgaagaaaagcatggagttcatgatttatcaggattccatgacggggctcgaaaaccgtaacagtttcatggaatactgcggtgacttctcaaaacgtatgccggctcccacaggagtcctatacatggatatcaatggcctcaagcggctcaatgatacaaaaggccatctgtatggagacatgctgatcacccgggtatccgatcagatgaaacagaattttcccaatgcccggaaattccggctcagcggggatgaatttctgattgtatccgagggactgacctatgaagcatttatgatgcagatgaaccggctggaagaatccttatcagataatggcttctgtatcatctcaatcggcaccacctggaatgatatctataccgacttatacgaatcgttacataaggcagaccggctgatgtatctgcgaaaacaggagtattacaggaaattcctgacgattgcgcccgaaaaaatgcctatgctgctggatttgacaaacgcaattctgaataaagagtacctgatttatattcagcctaagattaacttaaagtcaggacggatcgacagcgccgaagtattggtgcgttacagagaaacggatggttccatcatgccaccctatcagtttatccccatgcttgagagcgaggggctgatatcaaatattgatttctttgtcctggaagaggtatgcaggcttctgaccagctggaaaggaacggcgttctcagacatcaggctggcgatcaatttctcaaggattaccctgtttgacaatcactttttcgataaattccgggatatctttcagcgttacgagatcaaaccggaacagctggagatcgaaattacagagacgcaggagacgctcaacaaaaagcagatggccctgctcctcgatcagctgaagagccacggattcggcatcgttcttgatgatttcggtgtcgaatactcctcctatgaatttttaatgatgacggactttgatctcctgaaaatagacaaaagtatcgtacagcggtacggaacagccggcaaatgtgagattttagtcaaacatatcgtggaaatgtgccatgagctgggcatcgaatgctgtgcggagggagtcgagacggaagaacaataccgtttctttaaggatattggctgtgattatatccagggatatctcatcggaaaacctgttccgccggaacaatttaagcggtaa

SEQ ID NO: 3137 - DNA, 816 bp, Hungatella hathewayi
ttgaagcacgggcagtatttcgatatactgaaaaaaaagaaaggaaagagatatatgtttgagttgataagaattgagtgtaaaaaagtgtttttgccagtgctcctcacaaccgtgggtctgaccattaccatgtgtgtgctgaccagaatactctatctaagctatttactgcattatgatttggaggcgtgggaggtaggaacaggagtattttccgtgctttatcccctgctcgttgtgatgcctctttgttggaatctatattatgagcgtaaaaataacttccttttatatatcgcgccgcgtgtaccaatcagaaaatatctgactgcgaaatggaccgcctatacactgggagcattttgtattatggcggttccctatgcgctggctgcggtatacgcaatttatataaaagcgcccgtgattcctcctgaatccaacaccttttcgcatgtttttcaaacggtatttgttgagaaacccttgctttatgcggtcattctttcctgttggagaggagtgattggtattttagttatgacccttggctttacacttgccctgtattgtaaaaatatatttgtaatattaaccgggccatttatgtattccatactcgaaaattatataatgtcaattctgaatctgtcggcataccggctagttgttgcttttgacccaacgagtatgagcaacagtgtggtgacatatttttcgtttattgtggggccagttttgctgctctgtgttatcggtctgacggcgttctttcttgcaaaaatcaggaaaaatgccgtggtgtccgtatag

SEQ ID NO: 3138 - DNA, 3435 bp, Hungatella hathewayi
atgatacaaccgggcgaggctggcagaacggtccgttctttttttgatgcgtatctgatccggcggaatgtgaaggacacgctggattgtgtgacagataccgtgcattgggtgggaactggaaagtctgaactgtcaaagggacgggaccagacggaacaggcgctgcttacggaattttctcaggcgccggaaccgatgaaaatagagtatgacagcttcgacgagacggttgtttccgaccggtgtgccgtcgtgcttctcacggctgatgtatatccgccggggagtgaagaacccgggatttggtttcgggtgagcgccgcctgtgtcaaggaagaggatgggatatgcagaatcgcatcgattcacgcatcgacacccgaaaggcagcaggaagaaggcgggtattttccgaaatccatgctggaccggtatgaactggagcgggagcggcaggtgaaccagtatgaccatctttttcagtccgtgctttgcggcattgtgcagtaccgtttgaccggtatgggcgttgaatttaaaaatgccaaccgggaggcgatccgcatattcggctatgaaccggaggagttctggcaaaaagaggattgggatctgccgatgctgatcatggaggaagaccgggagaccgtattaaaagagatcgatacgctgcatgagaccggtgataagtccgattttgagtaccgactgcttcagaaggatggaatcccatgctggatcatcggcagcgcggaagtccttcaggacagcgacggagagcagtttatccagagcgtatttatcgatatcaacgcccggaagagggcggaactgaatgaactgcgtctgaccagacaggtagaggcgagcaatgagatcatacatctggctcttgagcataccacgacctgtgaattttattactatccgcagacctgtgagtgtcaggttccggagcggacttgcgaggcataccactgtcggagccggtatgaaaatatgccgtacagttttgcagaggaacaggtggatgaagcgtattatccagccttctatgcgatgtacgatcagattcaccgcggagaacggacggctacctgcgaattccgcggaaaggacagccgttattggagccgcgagaccatgtctgtgatactcagcgatgaagaaggaaatccgcagtttgtcattgggattgtggaggacattacccgtgagaaggagatggagacggcgctgaaagaagccagatcccgcgacagcctgaccggactctgcaataaggagagcgggatccgtctgattcaggagtacctggcctcaggaagagagccgggggaacatggcgttatgatgcttctggatatggatgattttgaggatattaatcagaaggagggcaatatcttcgcggatgcggttctgcaggaggtggcggatgttctgcggcaggtgacggataaggagagcattaaggtccgcctgggcggagatgagtttatgcttttcctgaaagactgcaacaaacaggaggccgggatcatcgggccgcgcatcgctgccatgatacggaatatcatcctcaatacggaaaaggacattcggattgcggccagcatcggtatgtgcagcaccgaagtgacggacgaatataacgcgctgtactgctgtgccgagagcacattgaaatacgtcaaggatcacggcaggggtaacgccgcctgttatctggatacctccagggaggtgggcgtgctgcttacacagctgtatccggatgagttccaggtaaacacggttgaccgggagattctgcacccggagaaggatctcgtttccttcgcgctggaactgctggggcggtcgaagaatatcaacgacgccgtgtttctgctgctatcccgtatcggaaagaactaccatttcgaccgggtatcgattattgaggcggataaagcctttttatcctaccatttttcctaccagtgggcgcgccaccactcggatctgcagctggggcaggatttctatgcctcggaggaggattttgaaatctgcgccaacatgtatgacgaggatggcctggccgatcacaatgtgagagacggaatctcccatatcgcatcctgccttcatgccgcgatctggaactatggggagtacgtggggtccatgagctttgaggtcgatcaggaaaactatcagtggacccgggaacagaggaagcttttaaaagagctggtgaaaattattccctcttttatcatgaaatccaaagccgacgcggtgagccaggcaaaaacagatttcctgtcccgtatgtcccacgaaatccgcactccgatgaatgctatcagtggcatgacgattatcgccaagagtgtgctggatgaccgtgagaaagcactggactgtttagagaagatcgagtcggccaacacctatctgctggggctgattaatgatattctcgatatgtcgcggatcgagagcggtaagatggagctaagctatgaatccatagatttggaacagcagctctccaatctggaatccttattccgcgcccaggccgaggagaagcatctggagctgacctttgaaaatgactacaggaaaaaacggctgctccgggcagacagcctgcggcttaaccagattctggtcaatattattggaaatgccataaaatttacggagcttggcagcgttgcggtccgggtcaaggtgctggaggaagagcccagagcgctgattcgtttttctgtcacggatacgggaatcggcatcgaaccggctgccatgagaagaatcttcaatgccttcgagcaggcggctgcgcttaccgcctcccgccacggaggaacgggactgggactgtccatatccagccgcctggtgcagatgatgggcggtactctggaagtacgcagcgaaccgggaacgggatcggagttcttctttaccctgagcctggaatatgcctgtgaagatgcggaggagatccctgtgcaggaacagaacgtggacattcctgatttccatggcagtcgtgttcttctggccgaggacaatgatctgaaccgggagatagcgcagacgattctggagatgaacggcttcaccgtggcctgtgcggccgatggtcaggaagcgttggatctctactgcggcgaagaacccggctggtttgacgtgattctgatggatatccgtatgccggtcatggatggactggagtcagccaggcgtatccgaacctcgggacgcccggatgcccgcagaattcccattatcgccctgacggccaacgcattcgacgaggatacgagaaaatcgctggccagcggcatgaacggccatctctcaaagccgatccaggtggatcagatgctggagattctgggaaaatgcatgggattgaagaaatag

SEQ ID NO: 3139 - DNA, 3834 bp, Hungatella hathewayi
atgacaaaagatacatcgatctccatggaccagctagaggcgatcctggacaattcaccaacgacagtgatcatcagtgctctggataaccgggagcttctttatgccaataaggccgcgcgttccggaattgctccggaatgcctgggacggaagctgacctgttatcaggcgttcggccatgacagcccctgtccgacctgtccggccgggacgctcgggcaggaggacagcgcactccgcgagctctttaatccggggaacggccatacctaccggtatgtcggaaaggatattgactggtccggccgcccggcacatattgaatatatttccgatatcagcaaacaaaaactgctggaacaggaattagaacaccttgtaaactccattcccggagggattgcaagctatgagataagagagggccgttttatccctgtctactattccgacggcgtgatggaaatctccggccacaccagggaagagtacaatgagatggtgaaaaacgatgcattgggcgccatctatgaagcggaccgggaacgggtcctgtcggcggctgcaaaagcactggaaggcggggaggttctggacgtatcttaccggatgcgccataaaaacggccgtctcatctggattcacttaaatggacggcagatcaaaacctcctccgaagcagccatgttctacgcagtcttcacgggaatgtcgtcggaaagccgcttatatcagaatattaccaacgagacggcggacagcatctatgtcatcgccagggatacctttgagctgctctatgtcaatgaaaccggcggcatcttttcccccggacctgactgtcttggggaaaaatgttacgctgcgctgcataacaaaaaagcagcctgcgaattctgcggcattatggcgggcaggctggacggcgaagagtatgagataaaagaggacggaaccgagcggattacgtatacacgttcccgtgagacggactggaacggcattcctgcttacgtaaaatacgtaagggatgtcacggaagcggttcagatccggagggaaaaagagcgtctcgatctctacttccggagcatcgtagaacaattccccggcggtatttccatgatgacgtatcatccggatggaacgatgaggacggagttcatctcaccgggccttgctgcgatgacacagcggaccgtggaggaggccggacacttgtatgatgcggatatctttgcggggatgcatccggaggacgctgaaaagaatcggcagaagtttcaggaatttttgaagcgcggaacaggaacctgtgagctgacggggcgtatgcagcgaaaggacgggagctatctctggacgtgcagtacgctgtccatgctgccttccccggatgagatccgccggatatatattgtgtataccgatattaccaagacgatcgaggagcaggaacagctgcggcgccggtacgaggagcagcttctggagcattatcataagaacggggccaatgaactgattctcgggcacagcagcatttcccgggaccgggtggtggaaatgcgggactccacagattccgcacttgtggaacggtttgggaggcgcagggacgcattttttcagggtctcgcggggctgattacagacagggaagatcaaaaggcatttttgaaaatatttatgaatgaatccatgctggacgcatatgcccagaataaaacggaacaggcgatgagctgctttatccgtcttcccgaggaaaaatacggccgctttgtccagttcaaggtcaatctcctgacaggtccggaagcaggtgagatcattggaatccttacggttactgacattacggaggaaacgatctctgaacggattttccatcagctgtcggtcacgagccatgactttgtggtcgatgtggaccttcttcatgattcctatgcgatactggcctgcaatgagaatgcgtcctacatccctgctctccatggctgtcattcgagacagacggcagagatggctgattccatcgtactgccaaaggacagcagacagttccgccatgcgctggaagcggatgagatacgcagaagcttaaaaaagggcccctatacgtttaccttttccacggaaaatcatggagatatccgcataaaaaatatgacgattgcctccattgaacctcttttagaacgctactgtatggtgtgtacggatatcacggattcggtgcgggagcagcaggggctgctgcatatgatggcatatacgtttgaacttatggggcttttagatgtcggcagcgggagcgtcaccgtgtatacccggaatatggtactggaaaatctgccgccggataccacagaagattatgcggaggctgtcagaacgtttaccgatcacgatattgcgtctgaatccgctgagaatgtgcaaaatcaattcaggctggaaacgattcttcagcggctggagcaagaaccttcaggctatgattttgttgctgcctgtgtggggacggaggggattcggtataagcagttcagcatgctttggggaaaccggaaccacgataccgtctgtgtggtccgggctgatgtcacggacatgatagcggcagagcgcgaggtaaagaaggaactggagcatgcgctggcggatgcggaggcggccaacgaggcaaagagtaatttcttatccgccatgagccatgatatccgcactccgatgaacgcaattgtgggcatgacaaccctggctttcgcccatatcgatgaccgggtccggctggaagactgtctgcagaagattaccgtatccagcaggcatttattgagtctggtgaatgatgtgctggatatgagccggattgagcagtcgaaaatatcgttcaatcacataaggctccagcttcccgacctcgtggaccagctgacagccatcctggttccccaggccagggagcagggcgtgcagctgtccatatgcgcagaacaggttacccgtactgctttttacggtgatttcctgagaatcaaccagattctgattaatctgctgggaaatgcagttaagtttacacctgcaggcggcagagtggattttcgggtggaagagattgtaacggaacatacaccgtcaactgtccggtaccgttttaccgtgcaggatacgggaattggaatgagtgaagagtttctgaagcatatatttgaacctttcaccagagaacaggcggcagaacgtatcgaaggaaccggtttgggattgagcattgccaaaaggctggttgatttgatgggagggaccatctccgtagaaagcggaatcaatcagggaaccaggtttattgtagaactggagtttgaagaggcagaacaaaccttggctgcgcataaggacagcggggaagaggccgatccgaaaatggcaggtatctttcatggacgccattttttagttgccgaggataatgaaatcaacgcggaaatcctctgtgagctcctccatatggaaggggcgtcctccgatctgcgggaagatggggccaggatggtggaggcatttacgtccgcggaaccggggacttatgatgtcatactcatggatatccagatgcctggtatgaatggatatgaagcagcccgcgttatccgcagcctggaccgcgcagatgcgaaggaaattccgatcatagccatgacggccaatgcatttgcagaagatgtccaggcggcattggaggccgggatgaacgcacatgtggcaaagccgattgatatgaatatgctgcgggccgcgttagggcgggttttgtga

SEQ ID NO: 3140 - DNA, 702 bp, Hungatella hathewayi
gtggaggacaatcgaattgcagtaaaaaagattgtcgaatatatcagcagaatatccgcgaaattcaatgtggtttctttcccggaggctggaggcgctctgcggtacgcaaaggagaacgaaatttctctttttgttcttgatattcagttagaggattataagggaactcatttggcaaagcaaattcgtgagctgccagaatataaatatacgccgatcatatttgaaacggcgctggcaggagaagagctttccgcctaccgtgatgtgaagtgttacagctttcttataaaaccatttagtgagaaagaatttaccgaggtatttactgaagcaattgggttgtctgagcggattaaccggcagggtaaaacaatccaaattgagcaaaaacaatttattttggagtatacgacggcggacattgtgtatatagaagcttttggcaagaggctggtcattcacaccaataaccatatgtccggtatgaaagaagataccatttccggatatacgttagcaggaatgctggcgctgctggagggcgcttctttcgtgcagtgccataagagttatcttgtgaataccactcatattgacagaattgacaagactgggcgaaaaattttcttaaaaggatttccggatgccatcccagtcggtaataaatatcagtctgtgttatgggggaagccatga

SEQ ID NO: 3141 - DNA, 2253 bp, Hungatella hathewayi
gtgtccggcggaaaggggtatttaatgagaaagaacagaataaaaagggtgctgctgcagatgacccttattttagcggcagcagccagtctgtatgggtgcagcagagacgggaaggtcatatctgatccggaaggagccgcggcaggaacgcagaagaatcaggctttgggaaggtatgcggagagcgaagtccctttgccggagggagtcacatatgattccggactcggttttttagaaggaccggatgggagaccggtcctgtttgccaggaaagaaaagaatggaacggcagaatttaccgcatacctgctgtccgaggatctgacctgggaggaaaaggagtgtggatggttaaatcagcttggtcttaagtatgagaacagcagcattggtattacctttggagaagaccacaacatgtatgcggtctattcggaaggggatgaccaggaggttatcagcagacaccatgttgtagcggccggggattgggaacatggacaggaactcaatctccctgttctgcttgagactggcgagtatgggtataagtattacccgcggtccattaccgtattggaaaatgggaacctgttattctcatccggaaataacatttacctttatgacgcggccggacaacagaagctcgcagagctgccaggcagcgacagctgttactttgccaggggcagccagttttatgccattgacgaggcttccgaaagtctgatattatatgacggagaagacggcaaagaaaagaccagatatccgctgaacttaaatcaatactttggagtcccgggcattgtcggagagaatggtgatataagtctgttgtcagtggagggaattcaggtcttgaaaaatggttccggaatctgggagcagattatagagggaaagagcaataccatgggttccccgaaatattatgcctcaggattcgcggcgggcagtcaggaggattactttgtctattacaattccatggatgaaaccaataagctctcccattacgtttattacccggatatgccggtagagccggaaaaagagcttaccatattctcactgagcgacaacaataccatacgtcaggcggtcagtgagtatcagattgagaatcccaacgtgaaagttgattttcagcctctcctggaggaagggtcagccgcagtcgctgacgattatatccgaaccttaaatgccgaactgcttgctggagaaggaccggatattctgatcttagacggattgtcagaggaatcttacatcgaaaaaggcgttttggctgatattacagatgaaatagagcgtttgactgcgtccggtgattttctggccaatattgcagaggagtgccgggtggatggacggatttactctgtgccggtcagaatcgggcttccgatgacattcggcaggaaagaggcgcttaaggaagcggggcagttatcttcccttgctgattatgttcaggcccatgagaccgggcaggtattcgggacggttgacagggaggcgttactttctttttacgcagatgcatttttaaatgatatcgtaaaggaaggcgatgtggtcgaggaaacggaattaacggaatttcttaccgatatgaagcggatcatagatggaagcgaggtctcagacggcacgagggaaaaacggccttccagcatatgggggctcctggaaaagggcacacatctgtattcaaatgtgatcaacggtttttttgaatccgggcagggagcttccattgtcgagcaggcccagggaaaactggaagcggacgttatcctgatcaatgagacgtatgtgccgtatggcaccataggaatcacgaaagccagtaagaatcaggatctggcaattggatttctgcagacagttctgtcggaagacgtacagtgttccgacttttacgatggatttgcagtaaatcagaatgcgctggagtttttatgtacggtggagagaacgtcagcggatgcatacggaggaactatccccggtgcggatggaagaacatacgatatgaaaattggctggccctccgagccgcttcgccgcaggatgacagagttctgcaaaaccgtgaagcattccgccggcaggaactggaaagagaaacagatcctgttggaatactcaaaagactactttgacggaaccgcctccctggaggacgcagcaaagaaactgatgacgaagataaccttataccttcaggaataa

SEQ ID NO: 3142 - DNA, 7038 bp, Hungatella hathewayi
atgctgactaatttgagttttgagtctatacttgcctatgcaacagagggcagaacagtaaaattccatgtgggtgagagtgtgaccgctgaattggaagacggtgttctgacattaaagggtaccggtgatacaaacgattttaccaaggaaaatgcaccatttctggagtatgcaaaagagattcacactctgatgatagaagatggcattacctatatcggttcctgtttgttttatgatctgggcggtctgaaaggagaattgaggcttccggagagtctcatggggattggtgattatgcgttctcaggcagagacgcagaacacgctccccgattttctgttgtgatcaatgaatttgatggcggggaaattgtcagccgtgattgggaatttctagataaagaacagaaggcgacaccttccaatgctgcgaaaaaatcaagtccgagcaatgcatatagtgagaatacgccaccggctttgaatgcagggattataccccatatccaggcgctgttgtgcgaaggtgcggtaacggcagggacaaatgacgatgattccaggacggaaagtggtattggaacgaaaacggaatctggagcggaaagtagtatcagagcggaaatagaatctgaagcaggaaatggtaccggaagaaaactggaaacgggagcagaagatggtatcggaacgtccccggaaacgagagcagaaaatggaaccggaacaccccaggaaacgggagcagaaaatagaaccggaaccccctcggaaacgggagcagaaaatggaaccggaacacccccggaaacggaagcagaaaatggagccggaacaccccgagaaaccaaaccagaaaatggaaccgtaaaaccccgagaaaccaaaccagaaaatggaaccgtaacacccccagaaaccaaaccagaaaatggtactggaacacccccagataccaaaccagaaaatggaaccgtaacacccccagaaaccaaaccaaaaagtgctgccggaacacccccagaaaccggaacagaaagtgatacagaaacacccccgaaaaccgaagcagaaaatagtacagcaacgaataccgaagccggagcagaaaacagtaccgaaacagacaccgaagcggagactggaaccgctgtggaaacagagaccggtgcagaaacagtgccaggagtagaaaatggaggagccgcagcaacggattccgccacagacaggggtagaaagaagatcaaaaatcccttggaggatgaagcggaatacgcgatagagtacataatggaacaacagatcgaaaacccggaaaccatattttatgaggatcagagaggttttgtgatttgttctcaggataatcagactttcatcgatgcggcggaatatgccggatacgaagtggcggacgggcttgttacggctgctttggatgataaggcagagatggaactgccggtccgggatgaacagattcttctgccggaatgtccggaagagatcagtctgctccatgaggataacgaattttaccaggagacgtttaaaggctggactttagaaggggaggaacctggcctggtgagaactcccggggagaccatttcttcggtggagggcgagtatctgagcttgtactcggtatgggaaaaggccgaaaactatcatttccgcgtggaagcgaaacgggaagggaacacggcagtgtataccgtgatcgataacagcaccggggagataccggaaaatccggatgaatttatgtaccggtaccagtggcaggttactgatcgtgccggggatatagaacagcaggaaggaaagaagatcacaatcatgcacgctgcccattcggctaccccatcggaagccgttggcagtgacatggagacggaaagcggctggacggagcttcagggggccgatactccaagatatgagagagagcttgaagaaaatcgtgttgatttatattaccggtgtgtgatcactcctgtgaaactgacacgttcgcgttccgcttctgaggcggttgtactgtattctgacgcagtggctgcggtagaggatatcaatataatttatgtagatcagttaaatggtaatgacatcaattccggaaaatccagcgatcaggccgttcagacgttggaaatggcggcgtcacggctaaataagagggaagccggaggaacagctgaaagtaaccagattatattgacacaaaattatacctataaaggaaatagttcggtgtctgagcaaaataaatggaagtggcattttttatcagataatgcagtcccagtcacaattaaaggtatcaatgataaaatagaattatcgaatcacgcaaacagtgcaaacaatgatttttaccagtacgaggaaattatctttgattctgttaaactgttgaacctggatcatatgtactgtaacggacacaatattcggattaacagcagtgttacaactggttcaaatctctatttgtatggatccggacagaatgacatcactgaaaatgtgggaacaatcagtgtatacgccggaaaaattacaagaattgtaggttatataagaagtaagccctctgtcgatgttaagcagaagaaagccgttattacggtagggggaagtgcagatgtagcgactattattgcaggcagcgccagtggagaaataaaaaatgcagatgtggaaatcaacatagaagggggaaatgtagataaactggtcggtggctgtcagggatacagtgaggccaaatctccgtattccggaactacggtccttaatatttcaggcggaacggtcaaaagcatctatggggcaggatcgggcaggaataaaagcattccgacattttccggtgagctggatatcaatataacggggggcagcgtgggtaatgtatacggctccggttctgcagcctatgttaccagcagcgggagtgaaatatcaaaagtaagaattactgcttccggaggcgtcgtaggaaatatctttgcagcaggtattggcggggaagccagtgtttctgcagaaaatgaggccaatcagacgttagctaaagattttggaagcttgacaggtgacgtaacaattacaattaaagacaatgcagagataacaggagatgtttatacgagcggaagcggacatgacacaacggggacgcccggatatgatatcacccagaatgcatatttgaaaggaaacgtgaccttgaatatctccgggggagcgattcagggaaatgtctacggaggcggtaaaggaatcagccggtctggattcgatgactgtgcccgaattgaagaaggctctacggtcaattttcagataagtggcggcagcataaagggaaatgtctacggaggcggaaaaaatgcgaaggtcaaaggaagaaccatcatatccatttccggcggaacgattcagggaaacgtctatggcggaggagaaaaggctgagataagcggctccacgtcaataactataaccaatgggatcatcgtgagtaatctctatggaggaggaagtgaaggtctggttcggggagatgcctccgtatccatcactggcggaacgattcagggaaacgtctatggcggcggcagtgaagggctggttcagggaaaaaccaacattaaaatagaagatggaaccattaacggttctgtttatggtggcgcgcttggcaaggctggcgagcgctatgtcttaggcggctccaccgtcaacctgacgggcggctggatacgcggcaatttatacggcggcagtgaattcagcaatgacgggccggaagaaggcgaccctgaagatttgattttccttaattttgtcggaggcaaggtcagcggcaaggtattcggcggcggctaccaggggattacgaatggatcgactcatgtgcatataggggtggaggcgataggagcatgccagcactataaggataatccgggtgaaaagcctgatttgaaggcctccgatctgtctgtggaaagctctgtatatgccggcggtgattttggcggagatactccggattacacaaccataactgtaaagggcttttcacatatttatatagacggagaggggtatgacttcggcggagatcagggcggcagtaaaatgagtatatcaggcggagtatttggcagcggagcctcctgtgacgccggttccgtcagactggtgaccgtggctaattatggcagaaagcttacggacgctgacgggaatctggacagtgtcagcagcactcttacatcgatccagagggcagaccaggttcgcctcatcaattctcatgtccatttatccggacagtcggatgcggccaatagtaatcagacggcattgtattctttaaaccggattggagatctggaaaagccggaggaagatcagaagaagctgggcgtattgggaaacagtctggtgctggcagacggaagtacgctggttctggattccgcttccatcgaactggctaattataagagtgttcagattacggaggcgggaataaaggaagtgaagtacgaggagctttccagtgtttccaatacaattatgctgacaaccggtaccgtattccttgtctctcataaatcagcggccgattccacgacggaaacgtatggggcggttaatgggtattcctacctgcttgcagaggagaccgcgaaagcctatgcctacgcccggattaagaacgatgatgctaatccggacgacggaggttttgccgtacccaatcaggccggagaactggggtatacaaatgtcattgaccagggcttccgcttctggcaggtggctggggccaatgccagcgctgtgcgggaaaccgtactgaccgcgcaaaagctggaagatgggccggcggatgggttctctgttgcatcaggcacggtcgaactgcctcctgcggagcatgaatcagtctataaaatcagcagtatcacgataccagccgcagttaagcttgcagataccgcaaaggataaggagggaaattggattaagtctgacgagtctattgacggtgacactgagaaaaataagattaaggcagacccgctgaacagttttggtctgagcataggcacagacatcggacttatttcagctgcggatcatatcatttcacccaatacggccagttcgggttcatcctatacgattatcggaaaaagctcagactctgtcagtcagggaaaggtacctaagattacgctgtacctgacctatgataacgacggaatcaccaagagccaggacttggggactgtgactgccgagatcgaacgttacgagggaaatgtaaaaaaagagacgaccaccctgaatatagaaatagtcacgaaggcggctgcgctgtccgatcagagtgtggaactctacgcgacacagagcggcaattacacggggaagctggtgataccggccggaatgagcagaacgttggatttaacaggtgtgaagaccgactttaagggaacaaccacattatgcagctatcattctgaaacgaagcttacagggtacaacatcgcagtcgccatgcagcctgtccagagtcagggatggcacagcgcggacctgatggcagaaagttatgatctgagcggttatatggaagcggattccgtgagaattggatcaaccgacagccggtatgaagcggccatagaatttaccctttacaacgcgcccggatttacggcaaagaacgatattgatgtggtggctttaagtctgcaggatggaagcggcgtgacggttaccattgaactgaatgtccgctgggaagaatcagcggtttccgaaataaagacagccggtggaaaacagtataatggtttcgaggcagcagaaaatattatgatctctcctaaaagttcgttgacggcatcgtttatactcagaaagccatacaatgctgcggatctgtggctcgaactgcagaagtcgggaaaaaggatcccgatcccggcgggaacgaaattgactctgacagaacagggaaaaccattttttatataccgtgtgacgggaaatgagcaggacgaaaagattaagctggatgatttcgagaagatgtgggccggcagtaaactgactggtgagacaggcagcaatccggttactgttatcatggaatttgactcatcggacgggataaccgcagatgagtacagccttcgtctccgcaatgaagagagcgcagattccataggagccggttttacggtgaataattcgtccgtgtctttagccgtaagcgggggcgatggtctttcccgcggtgagcatacgtttcagctggaggtggcgcttagaaacgatacccgtatgctggatggggcggctgtggtaatgcagcctgaggacggaaccgttttcccggacgggacggtattcaccgtcggagaaaagaattactatccggttggcggcagggtttatctgcccatcagcctgagcgatctggagaagggaagctttccggttaccatgaacaccacagataccgttggattacctccgggcgaaaaccgcgtatcggtacagcttttttcaacaggagtgaactccggcggagcggcaatcacctctgccgtaaccgattatacggtagaagaaaatccagaatatggattgaagatttttacccatgaggggaagcggctattttctcctggatcagaagtgatagtttatgcagattatattattaaaaatgcagcagaaggaattgcggtacaggttgagttttacaaaaaggagaatggctcttacgtgaaaatggacgactggaatgtaagcagcagcggactgcctgtcggcggacttccgcaatatacaggcacccagacattccatatcaatgtgcctgacgcagatcaaatgactccgggtacttaccgtctggtctttatccttggagacaggagcgttccgtataatatcattgtccggcagagcgggcagtaa

SEQ ID NO: 3143 - DNA, 1911 bp, Hungatella hathewayi
atggttaatatagacaaaaaaagaaagatgaaagtggaaaagatggacataattatgaactcgagaaatgatatggttcagctgtttctggattttataaggccgctgaaagcattttacagtccgaagagggcatttcttcatgtggggaatacaggggcccattacggtgaaaagtcggccaggatggaaggatgggccagggtgctctggggattggggccgctctggtcagcggataactccgggctttccgcagaacagcaggaggagataagggagtggcttgtactctatcggaccggtatcatccatggaacggatcccggggacagcgagtactgggccgacatatttgattatgatcagaagatggtggaggtggcggcgctcgtattttcgataacggtcaaccgcggggaactgtgggacacgctgactgacggccagaaggacaacctgtaccggtggctgagacagatgaatgactacgacatgccgaagaataactggaggtatttcagaattctcacgaatatgacctttcggctgctggggctggagtggcgggaagatagaatggaggaggactttgcgctgatcgaaggctcctataccggcgatggctggtattacgacggcaatccgggccaggtcgattattatgtggcattcgcgatccactattacggactgatctacgcacaacatatggaggcgctggagccagagagatgccggatcctaaaggaacgcagtacgaagttctttgatgattttgtctactggtttgcgaataacggggaagagattccttttggaaggagcctgacctaccgttttgcacacagcggcctgttcggagcgatggcctacgccagactcgatgtggattacggcgtgctgaagaatctggttttaaggaatatcgaggtgtggatgcggcgccccattttcgacaacacggggattttgagcattgggtacggttatccgaatcttttgatgagtgagagttacaatggatgcggttccccctactggtgcaataaggcgtttatcgtgctcggactaaatgaggaccatccattctggacggctgagcccaaggtgtacccttatgaaccggtgaaatatttaaagcacccgcacatgattgttacccatgatgacaacgatcacgtgctggcttacgtgacggggcagcatttggggctggatcacggcaggggcgcggaaaaatatgagaaattcgtatactccaaccagtttggcttcagtgtttcgagagggaccagcctggaacagggggcgtttgacaatactctggcattttccgtaaagggagagaaccgttactgcatgagatacggccagacagacttttcttcggatgaggagaagctttctgcaaaatacagcccgttgaccggtgtggaggtaataagcacagtggttccctgctccccctggcatgtgcggattcaccagattaccaactgcgtaccggttacggcagcagacggcggtttttccattgctcgggagcggtgctttgaagtgacggagggagccgggacgggcagactggaagcggagaatatcgaaatcacggaagcttctgcatttgtaagggctccatggggagtaagcggaattgtgaccgaaactgaggggacgacaaagcttgtgacgccgtttccgaataccaatttattctataatctcacggttattccgaccgtgacagcggaactggaaccgggcagccatttactgattaccagtgtgttcgcagaccgctccgccagtgccggggaaatggccgggcagaagcctttcgtgagtgtggaagagggaagcgttacaattgcatacagaggcaggacagtgactgtcccccttttatga

SEQ ID NO: 3144 - DNA, 13746 bp, Hungatella hathewayi
atgagaaaaggaatgtggaaggaaaccgcaaaaaggctgtcatctattttgctggccggtatgattttgacaacgacagtggcgccgccggtttttgcggttcatacttattactggcccgatgccatttctgcggatgcaatggaaataaaaaattggacctggaaggcagaaggagaggcggcagcattggctccatcggtcgggctaattcccaccggattatcacagcaggaaaccgcactgatgggaggctatacaagtaagttttggtttcaggacgaaaaggccaaaacaataacaattcccggtacatcggcagaactcgatttttcaaaatttcatcaccgttactttgcctgtgcagacagtcataacaccggtttctttgcacctgtaggcgcacaaatcgccttccaaaagatgtattatcccaccaataacctgggtgactatccggatttcttaaaaaatgcccctatggatatgaagacaaaaaagtttgccctccttcttgtcgcattgataagcgccgcttatgagactccatctacagcggatttgagggattctgatcggatgtccatgtattattatctcctgtgggcttctatctggagtaacgataagtatgtggatcagggcatgttcacaggagagtcgccggagggtgactgggattttatccagtattttgtacggacaatgctgaactccaggctaaatccagatccatatggaagtacggcaatttacgatgcgtttcgagatgaaggtcctgcacagaagtatttttttaactgctggaaagcagcaaagtttctgtcgtcgtttgattattctgtcgatatggggagcgtactgccggtttcagagcctgcattggacggggatggcatgtatcatatgacgttccgctatggggatctcagtgattatgagaaagaggtatacagacgaatgacagcggaaaacctggcgccgggctgggcgtattccaatgatggaagtaccattgattttaagtcagcagatggtgtgtcagatggaaacgcaatagcaactctgaaacttcaggaaaattcggaagaagatcgtttttataattgtggtttcggcgttggcggcctggccggattccgcggttgtgcgaaaagaggtaaaaacggcgattttggctggggtaatacgcaggtgtatttttccgcagtatctgaaccgttagagcttcttgtgggcggtcgggttcctttaaaaccgagcggggattgggaaatagatgttcaccgatatgagcatacggagacctgggaagcgcattataatattcaacttcgaaaatatgattctgagacaggacaaccgcttgccggttctaagtgggatattcttgaagcattcgatgatacccagcttgacgatacatcactggaaacctctgataactgggcaaacaggggcgggagtcagttcctgaagtgggatggttgggattacggagaagggaatccggacggagacgctgcaaataatccgtgttcctgggatatcaatgtaacaaatgaggacggcattctcatgctgggggataatgaggaaaatgcttctgaacagagggcgcataccgataccaaggtttatacctatacgaaggggtactgcggcggtcatccggaaccggaaatagaagaaagtggtgatccggatattgacgctgaaaatgaagctgctgcgaaggaggcatggcaaaaagaagtggactactgcgagactcttgcagaacagggcggcttttttcattcccttgatgcaggagaagcgaaagagcagctggaagctgaccgggataagttctataatcagtttatttccctgaaatacgaatactcagcagtagaattgactccacggccgggatatacaaatcatggaagccatacagacgatattccaattgagatcaaaacggttacgtcctcagagtataaggacggtgtgtataataaggaattaagtttacataagacaaaagacgaaccgcaagggactgagtcatcagatgcatttgcgccagagaaaaataacaattttgtggaaaaggaagcattggacaaaatagctacaccttctgacgccacatcatctgacgccacatcatctgacgccaccccttctaacgccacaccatccaataccgcagcttccaatgccaccgcctccaatgcaaagaaaaggaccggccttttgactaaactgaaggcactattcgaagtgccaagaactctgattgagcgaaacataaataatagatctttactcattgacgatgaggaagtcatgaaacgcgtaaattttgaaccctccgaggtggagacgcatgtaccgggcgataaagggattacagaccatacatttattgtctatgatcaccggactgaaggtgagatacatatcaacaaacgtgatctttatttgcaggctggggaaaacaaagattattatgcatatggtgattcgatgggagatggtaccctggagggcgcggtatacggcctgtatgcccttaaagatattaatcaccctgatggctgcaccggtaccgtataccaaaaagatgatttagttgcagtggcgtcgacagaccgaaatggtgatgcttcctttatggctttcacagaagctccggggatgatatggaattataaatctgggaagattgaaaaaaggccggaagcattcccggggcctcagaacctctgtcggaaccgagcagatgcggataaggtcaaagatattgaaaattatgttggttttgattcaaaaggcaattttatacatctgacagattccgtggcaggtgatggatcgggatactggaaattctcttccaatcagtccggtattgaaggcttgaaaggaagctatgctgcatacccggtatcggataatgataagaataatggaaactgctggatagggcggcctttaattgtggaagagaatggaaccacatactatgtaaaggaactggccagatcagaaggatatgagctctccgtcaatggaaaaacaaatagtattacaaatggcagagataactatgaaggagagtatcaagaggctgacgttgctattggaaaaatcactctcgatatggtgggaaatggaaactattttgatgtgactgcttatcaggcggatcatgatattacgctgcacgggattaaatttccggaaggagcggtgttcgaactatccaccagtgagaaagtgccggaaaaaattacggtgcctgtttacaggactgtattaaaaccggttatggcggcggcaggtacctttgtctaccagtcgggacagaaagtggctgccgtccggggagatgttgtaacctttcctgaagggcagagttaccgtgttaatgccgtgtcagctcgggaagaaaagacaattggtgttaaaccgatgaattatcatactatgggaacacctgcagtgacagaactcttttcaggaggatctccgaaagactttcaagcactctataatatggaactcgacaaccttggatataaagaaccggaggcagatgctccatgggtgcgcgtaaaattaagcggaactacggatacagaatggatcctctctattacggaagctatgaaagcgcatagcctgcagtattttaacagtctgaggatctctgatatggagcagacaggtggagagctctatgctattatgcgttatgaatggaagatttacgatgacagccgggatgatgctgtttataatccggagaaagactgtctttatgtaaaaaaagacagtggcaatggatattttgtatatgttccgtacgatgaaccggcctccaatccggcagtactgtcctatcgtatgaagaatggttttttggagcgggcgacattaaaagagcaaaatattgatggactgaatgtgtcttacccgtcaaaactccctgaatcatttgccatggtgaccgcccggacaccatcatactggatatatgcgccaggtgagcagcagatcgatgacgcgggaaattttaaatactccgaagagactatcgtggattatgtggagcaggagggctttaagacggttgaaaagaagatcaggcttacttctacatatgataccgcaaaagaaatctatgtggttacgcttccatccgatgcttttaaagagacggatactgtcaggcttaaagtatctgatgacgggagtgggaagtattcgatcaagcaggcgtacatcgaccagagcttctttgcctgccagcccttgcagcgggaggcggattcctatattcaaaatgtaacacttacaccgccgaccatcgatcagccgtggcaggatggaaatacaagaacagaacctgccgatgtgatggaacgtcctattatgcagaagataaaggttgtgaaagatattcttgttgaagaaggagccaggtatgaggacaatacatttgctgattccggccatgaggactattttacacagaacgggggtgggacgaaggataacgtatcgttcaggcctaatttccgtttcaagatctatttaagatccaatctggagcaattgtatcgaacggaagatggagagattgaatggcttgatcgaaacgggaatactgttgatgctgctgcgtatcgggcggcatatccggcaagagtacaaaaaatctatacgaaggtactgcatcgtacggatttacattccagaagatccaatagagacgcaatcgccaaccaggaactttatggttttacggatggtttgatcaatgaaaatcaggagacgggatatactgcaatactggagaccactctgtctcatgaaacggatgccaatggaaatgagaaggagaccagaagacttaattatgagaagttttttgatgcggtaagggttgcaaatcaggataagtgggacaaagcaaaacaggagcgtacttcttttaagcccttcgcattcatcagacgccttctgtttggaactgccggttcagagtgtatttatccggcagagcataataatacggaaatccaaaataaagccaatacttctgtaattgcaaaagaaaacagtgaccgatctgattcagttaggcaatttgctattcaatggtatctggacagagaagtagaaaaactggtgagagaaaacttcacaggtgaaacggaaattgcagccggccatgaaggctatcaggatgaggtatatgatactgctctgaaagcggctgtaataaaggccgaaaattatttaaaaccattctttcattatgacctggatgagatttatgctattgagtgggacagtgaatcagatggaggcagggataaagacaaaacaaccctgagtgcggataaggaggaggccgctttcggatactgttatggcatatcggaataccttccttacggaacctatgtaacagtggaacagcagcccatggataaggaactgggagatttcctcaacaaacattatgcaattgatgcgccaaaggaaattgagttaccggctgtctatgaagacgaaaaaacaggggatggcataactccggaaagactgagccgttactataattacaacacgaatctgtctgcggcagacctgacagcgaaatattttatccgttttaatgaggagtggccgggagaaattgatgaaaacgtaaaggattatgtaatcaaggctcatggatatctgggggattatgagatttataagtatggacttgatctcaataaaatagcaggaactgcattgggagatccttacaaaacaccgcattttgagattactcagagtgaatatgatccgctgaaagattactatcatacaattgtttttccggaagaagacggaggaaatccgaacagccactacctggctgatgatgttaatcatggggtaactgcgcctaatggaacggaatacgaacgtgacggcatagaacggatctaccgttatggttctgtttctgaaaataagcagacgtatgatgccgtttcttattctggagagtatgaagcgcaataccaggatcacgtatctgctatggaaggtatgcagacggcctatgatggtaaatatgcctccatgctggtaccatggaccataacagaacctgtaagtgaagaacatgataccatacagaacccggatggttcagcctccggggtgggatatggataccggaaatttcgaaataccttttacagaagccgcctgcgcatagaaaaattggattcggagactggggaaaatattctccatgatggggcagtttttacagtgtatgcggcagaacgtgaagatggagagaaaacagatggtcgggtaaagttttataagacggataccctgataaaggggtccagagaattcttagaggcgatgggtgcgaaagagattacaaaggcggccagagcacttccgggaatcggcggcctgtggactggaattgtggaggcgggaacccctgtatgcagagagtcggagcagattatcatgacgaatgcaaacgggcgcagaacagggggatttgaagcgtatacgacgacgcgggatggtcttcaggcggaggaagagaacccgtcagaaaaatcctggcaggatcagaatacaggctatctgatcactccccagccattgggagcggggacctacgttttgtgtgaaatgaggccgccgtccggctatgtcagaacgaagccggtcgccatagaaatttattccgataagatttcctactatcttaatggaaaccaggacggccgggttgtcgcggcagtctatgaggatggtaccgtactgaggccggagggggcaaaagatactgcgcgggtttatgtgggaaatacaccgatacggcttgagatatccaagttaaaggaccgggacaggaccgttacttaccgtacccaaacacgagttgacggaagtgaaacggagctaaaggccaaatatggtcaggagaatctggagtttgcttataaagagggaagctatttgaactatgcctggtataagggaaccgcagaatacttagagagccgtaaactggcaggagacgcggtagaaccagtctgtatagatggcatatttgctggttacggcctgataacacgcccattggacactgcagatgatacaaaccgttacgtttcgggggcgaagatggctttgtatgatgcggtcgaggtcaaatcaaatggagacagcggtgattacggctacgacggcgtagaggtgttgcgggaccgcaataacaatgtgcagagtataaagcttttggaaggatatgcaggaaacaccgtggagtttgtcaatttagttgatattgaaggaagccttagtggaagtaccggtcacggtacctggacttaccgaacggttgagcggaaggatacggatattctttactattcattgggcggcctaagggttacagaactgggaagagacggaaatgtgtatggctatgaccgtgatggaaaccgtattcaggtgcgtaatcagaaatccgtttatgctataaaaaacggccatcctgtctttgaactcaccggtggagatttggaacatgcagtctattcgtccctggataaatgttttaagctacaggaagggactaaactttaccatgtggattcagatggaaacagagatgcaaagatcgaccctgcaacaggaatggcctatactacggaggtggggacggaccagaggggaaagaagtatgaacggattctggtctggccagtcaacgtatccaagacggtaaatggcgctgttatcgcacaggaaaaaataaagacataccggattgcgtcgattcacgcagatacagaggcggagtatacgattggaacttacgatggaaccatgcttaaaaagtctgtaaatccggtagttggaagccatggccttccggattattatcagagatcagaccaggtatataaaaaaggagagcctgtgtatgatattgaccacgattatgtgaggtatcggtactatgatcttttgcctgcgtttaaccggaacgcttaccggattaataaccaatgggatttacgaaatgtaggcgaaaaggaagatccggcagatgataagaaattgtttcatcgtcagggggaagcgtggattatggaaaacacgtggatgtcaggagatgaatatcccaacgatccgtttaatgtcgatcttacgacagggcgggcagacatgctgaaacgcgtgattccgggaacttatattatggaggaggtggagcctccggctgggtatgtaaagggatttccagttggtatcacagtgaaagaaacaaaacaggtgcagaatgcggagctggaagatgaaaaaataaagatcgagatcgtgaaaacggatgctgcggatcagtaccgcatagatgtaatcagcgattatcaggggatattgaagacaacggaaccaaagggcgcttacagctatggtcagatttcaggggcccatctggctctttataaggcccggaggaagtatacgacagatactgtcacttatccctctggctactacctggagaaaacagaaaatacacctgcaaagtggactgtagaaaactcggaagataattcaccagtcatagtgacagcagactggattacagatggaaagccgaaatattttgaagggattccggcaggtgactatattctggaagaaatagaagcttccagtggttatgtccgtcattccatggagttggaggtcaagaaaacaggagaagttcagacattccatatgaaagacgaccataccaagcttgaagtctttaaatactgcatggatgggaatggaaatatgataccgctgccaatggaatattccgcaggtctggcactctacagagccgagacggatgaagatggaaatattaagatgaatggaggagagccacaatatgtaaaagaccagctaatagatgaatggatgacggacgatctcaaagcttatacagaagactatgagataagtcctaaatggctggaccgcatgaaggcctttttcggacttgcagtgaatcaatccagttttatactggattttgaaaatacataccggaagttgggagataattttgtatggctgacatggcatacaaaagcaggtaaaaaatccgcagagagaatttcttccataaagatggacgtcacagacagcgcggtacagttgtggagaacggatgacggtaagatgatcagaatcaccatatatcgaaacgtccataacggctctctggatgaagacggacagcttcccctgaatttcgaatatcagttcaactaccgggagctggcagcagggctgaagagctacgatacactggaaggggttcacagaatcgattatctgccgtttacggatataaaagatggccgaaaagtgggtaattacgttctgattgaggctgaggtcccagaaggctttgaacgtacaaagcccaaggctgttgtactggaggagaatgggagtgtacagcgattcagcctggagaatgtggaaaagtatgtatccatattgaaagtgatttctgacggaaccaatgaatatgccgtggaaggggtaaaaatggccctctatcggccaggaacagatggaagctttattcatgatgagagaaatctgatagaacgttggatttcgggtgccgatggaagatttacagaagaagagtggtttttgggaaatattccggaaggctttcgggtcggagatataagaccccatcaaatcagtaagataccagatggtacttactatattgttgaggaggaggttccgccatatatggcaaaacgggaaccggtaaaaattgagattggcggtgatacggctacgataatccgtgtggtgaatcaaccggctcagggacgcctggaactgcttaagaaggcggccgatacgggagaactgctggaaaatgccagattcctgatcacgaacagagacacaaaggaggaatggtatattacgaccggtcataatggacgtgcagagcttaaaaatctggcagtaggcgaagttcgggcagatggaacaataaatccttatacttatacaattgaggaggtctcgccgcctgattattatcagatctcggggggaaagaagttttttacctttgatggaacggctgacagtcaggttgttacgtatacccatgcggtggaaaactatcccacacaaatacatttcaaaaagaccaattttgataccggcatggcgttggaaggtgccaaaatagctgtctatcatgcagtagctatagacggagaatacgtaaaaaatggagaagccattgaaattaatagatccgggccggagggatttacaattaaaaagaagttatcagccggtcatgtctatattatggaagaaatggaggcaccgaccggcatccatttgtcgcctccggttatctttacagtgaatcaggctggaaccggcatcagtaatataagaaataatttcagtgtactggaatgttcctctgccggcggaaccattgagtcactcactgtttttggcagggccgcggataagacctttacggttttgaaggacctggataccggggaggtgctgcctgatatcatcagcagtactgatattttacttacggctgatgatggaatagaggaaggccatttgtacgaaataaccgaatatacccgctattcagatggtaatacggagatgagtaaaaaagagacgaggagaatctggtttgatgagaatgggacatttcttttgccatccaggacatatcttggaaccaggcttcaattggaaaaccaggctcgggacgagcttgatacatggaccgtggagaatggaagttttaagcatgtaatagaaaatcctgttacaaaggaacgtgccgtcgcagaggtcacgggaactgtgggtaacggccagatgccggtcacaaacggcgatgtaataaagtacgtcatcacatacgaaaattctggtcttgaaaaagcggatctgattgtcagtactaaactggaaaaaggcctggagtttatgagatcatccgggaaccctgtaaaaactgaaggtatactgacatggcagattcatgatgcagaaccacactctgttgggcacttggagttggctgcactggtaagcggtcagatgggagcgtcagcaagagcggtatttactgtcagttctccaacgaatctcacggaaactatattggaaaatcctatcgcaccgaaaggaagtctaacggtcagaaatcacatttccgggacgggaaggaatccacaggatacctttacatatcagatgcgtttccttgattcgtcaggtaagctgctgtccggttatcagaattataccggaacaaaagaaggcaggataaagggaatgggacaaattaccctgaagggggacgagtatgttatttttcccggtcttccctatgggactgaatatgcaattatccaggaagtgaacagagattatgaaacagtaaccagagaactcgccggagcaatatcaaaggaggcacgaggggcagtctttgaaaataacagaaacgatgagacggtcagggaagttctgactgcaggaggcaattaccgtttgactgaaacaacgggatacacggacggtatggagcagactacagggatataccggttcacattaaatgaatccggaaaaattgataatgtggacatggaggaccggccggtaaaattatacttttccaaaattgatattgctgctggcgacgaaatttccggaggtatctatgcagtggtggatgcagaaactgaaaatgagatttacagatttacgaaagcggagtctgtaccggttcttattccggcagatgtactgataccaggaaaagagtacattcttcgcgagggtacgccgcctgacggttattcacgggaggaagatatacggtttacggtcaatgaggcggggattccggaaacaataatcatgcaggatagaaagaccagaatatatttggagaagctggatgccgacactggggaatccgttacaggcggctattactgcgtaagagatatagagagcggcgaaacagtcttctgttatactgcctccggtaagccggttctggcagagggaattctggcagccggcaggacgtatgagctggcagaagaaaagccgccggcgggttatggatactgcgaaagcattgttttcaccgttccattggaacctgagacgattaccgtacgtatgaaagataaaaaaacagaaattattgtgaagaagctcactctgccgtctccggcaaatgcaagcccgtcggatgcggaacgccaaaagccaggatttatactacagatcctgaataaagacaaaagtcctgctaaagcggtgagagacttctccggatttaaagcaggcgaagagctggtctttactacagagctggaatttaagaccatcagcggtcagctggcagcaggcggtgaatactggctgcatgaagtaaaaccacgcgatggttatgcatttgcggaagacgtgccgtttacggtaggcagagatggaagtcatgatattgtgattatggttgataagcctacccatgtggtactgtcgaaaaaagaacttaccgggagccgggaactgccgggtaaccatatggctgttcttgatgaagacggcaaggttttggaacgttggatttccggtgaaagacctcatgacattacagcaaaattaatagctgggaaaacgtattatctgtgcgaggaaactccggaagctggctatgcttatgcggagaaagttccttttaccgtgagtgaggacggaagcaccgatctggtagaaatgaaaaatgatatgaccagagtacggatcaataaaaaggatgagtcaggaaataccgtaaaaggagctgtactgcaggttcttacgttcgaaaaagataagatcatattcgaatttgaaactactggagaacccgtggaggttaccggaaaactgacggctggagagacatattatcttcacgaaaagcagtcgccccctggttatcttccggcagccgatatttcatttacagttccacgaaagaatcagcagatagaggttacgatgatagacttgaagcggcatgattctgaaattaataccatgtatctgatgaagacggacgcagagacaggaaaggggctggaaggctttgaatttacggttacgggacccggaggaaacacctataccgttattaccaacaaagaggggaaagctgaattctctatgccgtcggatgggatctatacattccgggagacaaaaagaaaggctggatatcttatatccgaggaaacctatacctttacaatcttgaatggaagagttaccggggatagtatgattctggtggcggatcagcctcttcctccggaagaacctgatgataccaggcgggttggaagaataacggccagttataaatcgggattcagaggcatgatctgtgcggcggaggaaaccagccatccgaccggtgaacggactggagatgagtatccgcttggtgctgttctggcagctatgctcttatgtctggcaggacttgtatacagattaagacggacagattctcgaaagcatgacagagaaggcagcagatga

SEQ ID NO: 3145 - DNA, 1668 bp, Hungatella hathewayi
atgcataaagcattagatgaaggttatattgatttgatgattgaaaacaatctggcggaaaatctcaaacatgattacgatatcacgagaatcaatgacagatattccattttacattcaccgcaggaaacgcttgatatgtgttacctgggagcaaagccctaccatgtattcccgaccatttattctttatgctctgagatttcactggaaagctccggggtctctccgattcagagcaaccccaatttcgaccttttcggacagggggtgctaataggcttcatagacacaggcatccattatcagcacccggcctttttaaatcctgacggttcatcgagaatcctgtccatctgggatcagacaatcgagaacggcggaatccgttccgatatcccgtttgggtccgagtatgataatgatatgatcaatctggccctgacggatcccaatcccctctcccttgttcccagcaccgacgagatcggtcacggcaccatgctggccggaattgctgccggcagtttggatgaatcacagaatttccgaggggctgcccctaagacggaactcgttgtcgtgaagctggcccaggcaaaagcttttaaccgcgccgtctttcgcattccggacaacgtcatctgttatccggaatcaaatatcctgattggtatcgaatatattaaaaaggttgccaatcagcttaagcgcccggtagtcctctgtgtgggactgggatccagccaggggagccatgaagggcacagcgcactaacctcctatctggataacttatcggtcattccccgaacaagtgtctgcgtggccgccggcaacgaaggaaataagcgtaggcattacaacggggttatttttaatgaagaatcttataaggaaatcgaactcagagtaggggaacttgacagacagttttccatggagatatggcagaattcacctggaaggcttgatgttaagattctgtcgccgaatggtgaacagaccgcggttgtccctccgcaattaaggagctgcattgagcataattttatattcagcaattccaccgtttacatcaataatattatcgtcgaagaggagtccggtgaacagctgatcttactccgattttcaaatgcaatgagcggtatttggaaaatacaggtttttaataccacgaatataacttcccatttcaatgcgtggctgccatccggaaacatcattaccaacaatacatttttcctggactccgatccctataccaccattacctcacccggtaattccaacaattcagttacggtaaccgcgtacaatcagctgaataacggcatgttaatcgcttccagcagaggtttttctgccaacggaaccatcaatcctgacattgcagctcccggattcatgctgaaaggtccaaacctaaaggacggctatggcagtgccaccggcacaggcgccgcagccgcccacaccgccggtattatggccctgatcctggaatggaacgtcttaaaaggccattatacgaccatttccggcagggatattaaccggctgctcatccgcggggcagtcagagatgccagtatggactatcccaatcgcacctggggttacggaagacttgaccttatggggatgtttcgaagtctggtttaa

SEQ ID NO: 3146 - DNA, 1467 bp, Hungatella hathewayi
atgcaggagatggatggagcatcggaaaggaaccgtatggagtgggagaaactgctttcaaaggaacgtttttatcattcgggagacagggaagaatctggccggaatgattatgatacgattatcaggagtacgctgtttcggcggctccaggacaaggcacaggtatttccgctggaggcggacgattatgtcagaacgcgtcttacgcactctctggaggtatctgccatcgggaagaggctgggagaactgacattccggcggctgaaggagaggcggatagacgcctggtttgatgaaaacccggaaacagaattttcagatacgcttctgtgtgcgggattggtgcatgacattggaaatccgcccttcggccattttggagaatatgcggtacgggagtggtttcagcgttatttgaaggacatggagctgggcggacgcagcgtcacagaggtgctggagcgagagatggtgacggacctttactgttttgagggcaatgcccagtcgctgcggcttctttccaaaacacctcatctcgggaggcagcaggggttcaatctgacgtaccgtgtgctggcatccatcatcaagtatccggtctcctcctttgccatgaagaatggcagcgggagcagccaatacggaaagttcggatattatgtggcggagcggccgctctttctggcagtcgaggaggctgtcgggacggccggagcgcgccatccgctgtcctatctcctggaagcggcggacgatatcgcttaccggacttcggatctggaggatgcaatggtaaagaagattttgacattttcccagattgccgccgtgctggaggagtatgcgactggagacggcataaggggagacgggagaaaggggatgacggaggcagttcttcttctgaagcagatgtatgaagaggaaattgcacacggtgaccggaaaatgggaggcgctgtggtcaggaacccgaagccggagctgacagccatccagcgttggaaccggtacgtacaggagatgatgatctgggacgcggccagttcgtttgagaaaaactatgatgcgataatgaacggcacctttgagggagatctgctgtcggggacgccgtccgggtgcctggtggaggccatctccaggctctgcgaggaggtggtctataccagccctgtgaaaataaaggcggagctgttcgggcgcagagtcatcgattccctgatgggccagtttatgccggcggcagtcaaatatgatactggcgaggcaatgacatttatcgaacggcggattatggatacggtgtcggacttttataaatccatgtaccacgcacaggcggcgggaaagggcgaagaggagaggctgtatctcagaattctgatggtaacggattatatcagcgggatgacggataattatgccagacggctgtaccgggagttgttttcctga

SEQ ID NO: 3147 - DNA, 1260 bp, Hungatella hathewayi
atgaattttatacaaaaagtaactgcgccaattctgccaatcggtgacgtttcctccttctccctgatcggtgatccgggctgcgaggggctgggaaccacaatgatgcgtgtctatgtcaacgcgctggaactggcttcccgggatgattttattctgattgccggcgatatggtaccgactgggaaaaggcggttttatgagacgatttctgaaatcaccaattctgtggcgggaaaggacacgtatattttaagagggaaccacgacaccggagtgtataccgaatattttggactgcagaattatgcgctgatcggcgattcatttactgtggtagtgctggacaacgccatgcgcaccttcgaggctgaggggctggagctgcttggacgggtgctggctatggaagagtgcaggaacgtggtgatcgcatttcatattccgctgcccaaccattttatccgaaattctgtctccgaggcggaatttgaacgcctgagagccgtgtatgcgccttacagggaaaaggtgaagtactttgcctgcggccatgtgcattccagattcgaggatgtggtggacgggattccattgatctgcagcggtggcggcggagcgatgatcgaggatgtctcagaggaaatcaaggcttcggatgtggattaccacatcgtgaggttttttatggaggaaggccgtctctgccatagaattgtggatttgacggagatgtattataaaagagagcagctggagccggttttgaaagagaagctggaggaggcggtgaagggggagctgtatgcccatctgcggtatttgacatttgcggaccgcgcgcagaaacgcgggtacgaaaaggtggcgaatctgatgagggctctggctgattcggagtatcgccatgcacgcagcttttttgctgttctggaacagccggtgccgtttatggaggcgctgagcggatttagaaagagcgagaattttgagtttgagagattgtatcctatggtatcggattatgcggcgggaatcggcggaatgctggccaagcaggcctttgctgacgctgcaaagatggaacgctcccatgcggaactgattgcaaaggcggagaagctggaggagttttccgtggatacactgtatgtgtgccctgtatgcgggtgtgtaatgaccgcggttgacgagattgaccggtgtccggtgtgcggagcgccgaaaaggcagttccgggaatttacgggcaaagaatag

SEQ ID NO: 3148 - DNA, 1527 bp, Hungatella hathewayi
atgaagcaggactataaagaatatgaagagaaaataaaaatgaatgacaacttaaaatttgatgcagagagaggtgagaccagaacgtatgaagcggctggtaaaaaaatcacctgcagagcttatcttggaattgtatactgtgaacggccggccgaccctgtccagaagctgaatatatttgttcccgaggcgtacggccaggggggaacggtctgcggatacacgaaggataccgctccaatctttataccgaatacggtaggcggttatctgccggggccggcggatgagccggggctgaatataagaaccggaatgcccaattcgatctttacggcactggagcatggctgtgtagttgtctccggtggtgtgcgtggaagaacctcgggaaagagaaattcagagttttttgaggggggaaaggccgatgataccggacagtatgatgggaaaatggtgggcaaagcgccggctttgattgttgatatgaaggcggttatccggtatatacgccataatcgaagtctgattcccggagataccgaacggatcatcaccagcgggaccagtgcgggaggtgcgctgtctgcgctggccggcgctgccggaaacagtcaggattacgttccttacctgaaggaaatcggggcggcagacgaacgtgacgatgttttcgctgcaaactgctactgcccaattcataatctggaaaatgccgacgcggcttatgaatggcagtttggaggtatccgtgattactaccgtacccggcatcagaagactgaaaatgggataatccggatcccggaagaaggcacgatgacggacagacagatggagctgtcacaggaattacaaaaccgatttccggcatacttaaacagcctgaatctgaaagatgaaaatggaaacagcctgaagctggataataatggtgagggaagttttctggaatatataaagggacagatcctaaaatcagccagcagggaactggcatttcatggcactgccagtcatttatcagggttggcagcgcctggcagcgctgtggatacatttccggctctgacgattctgggagaaagtgcggtcgggctggactggaaggcatatatgaaagcgattacccggatgaaaccggccccagcttttgacgctatagatcttaagagtcctgaaaatgaggaatttggctctatggaaatggaagccaggcatttttctgaattttccatggagcacacggagaccgaggcagagatggctcccgcgcagctcattcgtatgctgaatcccacgcagtacattggaaatgcggatacggcaaaacactggcgaatccgtcacggatcatttgaccgggatacatcgttcgcaattccggttatcttagcccttttacttgaaaataaagggtatgatgtggattttttcctgccctggggaattcctcacagcggagattatgatttgcaggaattattcgcatggattgacacaatctgcggacaacaataa

SEQ ID NO: 3149 - DNA, 2769 bp, Hungatella hathewayi
atgatttttctttcattatccgatgtgattggtaaatataatttgcattataagatacacgctgtcatccaactgataaaggaaagacggaatatgaagcagaatgactattttatagaagaatcggagcgtgtaatacaagagagaacggcagatggacagttttatatactttataccgacatcacggattttcatctggttaattacatttacggaaatgaaatcggggattcccttctgcaggaaatgaatcatttcctggacagccggcccaatattctgttgtgccgccgcttgtttgccgacttttttgtaggactctatttcctggaaaatggacaggagatcagtgaaataatcagcggattggacagagaactgcaggaattcctcacggatttgcagtcgagatatcctgcatgccgtttaaaagcagcctgcggcctctgcctcattgagcatgataatatcgcgcaggccatcgacaatgcaaatctggcgcgcaaaatatcaaaaaatcagtattccttcaaaaccgtggtttacgatcatttcatgaaggatcagatcacagccgtgcatgaaaatgaactggaaatctacaatgcgctccatgaaaaccgtttctgtttctatttgcagccgaaggtggatctgacgaacgggatgatcataggggcggaggcgctggcaaggcgtatcggtgatgacgggactgtaattccgcccgataaatttatggatctgatggaagcgaagggatctgtgattgagttggatcagatcatctgccgacaggtctgtgagttcctgaaagaccggatggaccggggattgtcggttgtttgcatttcggtcaatttgtcgcgtctccatatacgaaatcccgaatcggcagatgtgttccaccagattgcagccgaatatgggattccgcctgagcttctggaatttgaactgacggagaccattctgctggaggaattcgccggagccaagcatttgatcgatcagctgagggcttacggccatcacgtctccatcgatgatttcggttccggatacgcgggaattaatgtatggcaggaactgaacttcgactgcctgaagctagaccgcaagtttttgtccgatgatgagctgttaaaaaaacgcaatcaggcgctcgttcccaatattatcaacatcgcccaccgtctccatgtccaggtgctgtgtgagggagcggaaacggaggaacagtgtctctatctgctccggctgggctgcaccgtcgtgcagggattctacttttcaaaaccgctgccgccggaggaactgtgccaggtctgtgaacgccagggcggaaaatatccgcttcccgcgctgctgtgctccgataagtcagaacaccagtccgaacagacgaaggaggcggatgacggaggcggggcgcagagtaagattaaaagttatgttatcgtcattctttgctgtgcacttttcctgggagtctgcatcaccggtgtcatgaccgtgaaccgaaaccggacgcagaaggaatttaccagcatgataatcgaaacgctgaatgcttacactgcgggacagcgcgaaaataccctgacggaaatcgatggtgttgtgaatacactgcagtcatttgccgtgttgattatggaaaatgacgagccggaatttatcaatacatttttgagtgcgctgaataaggtgagtccgaagattcagtatacctattatacttacgggatgtatcaggagctgattacgagcggggaggcaagaccggaggacagtgaaattttagaacgcctgaaactgggcgagacagtggtgacagatatcatttattctgagcggctgggagacatctactgcgtcggagtcggagttcctgtgatgaaggatggggtgttcattggcacggtgcaggggattatcaacgcagaggcgctgatatctacagagctgtttgacccggggctgggagagatatgcaatgtatttcttactgacggggacagcaggattcttccgatccgggaaccgaatggaagaggcgttggtgagagtctcctggaacttttagatatctatggagtaaaaaaagaggtgatagaggagcttcatgacgcctatgatgcaggggattcccaggcaagaagcgtccgggcaggcagatttgacgggagtccgtattacttatccatgaccgggctgagatataacgactggtatctggtcgtctgtttgaaggccgatgccgcaaccatgcatttgcgctacattgtgaacaatatgatgtggagtatcgccgggctgattgcggcggttgccctggtttcggcggcaatgattcttttctgggtgagagttcagaacaggatttccttagaacagcagcgctatcttctgctggaacacttttcagatacggtactgtttgactatgactgcaggcacgataccatccgattcacctccaatgcatcgaagcttttaaagatccgggagctgacacagaatcattttctgaatgggctggaccgggcgtttatttacgcgggagatcaggaggaggttcagcgtgtactgagcggtcagactggcggggaatacggcgaaatccgagtgcgcgtgatgcgcccggataccgaagaatacttctggtgtctggtgcagtatcagaatctgtataagagcagcgccatagattccattattggaaaaataacggatattgacgagcgtatgccgcatgaataa

SEQ ID NO: 3150 - DNA, 1416 bp, Hungatella hathewayi
atgagaaagagagaaaaaagatgggtaagtctggcactggcgtcatgtctggccatcgcggccttgacgggatgcagctcaggttccggaaagaccggagagacgaagagcgctgctcaggcagagacagaagcaaaagcagaggcaaagaaggaggaggacaaagaagagaaaaaggaggagagcaaggacgaaaacaaaggggagaacaaagaggaagtcacactgacatttcttcaccatatgggggaacaggggaagaaagacggactggtagcgctgtcggaggcatttacgaagaagtatccgaacataaagatcgaggtggagttcctttccagagatgattttatcaatcagtacaaacagcgggtagcggcggacaatgcgcctgatttcatcaattaccggccgtttgagacgccggaggtcatagaggccgggttggtggaaccgctggatccctccattttcccggataatatcgataagaattgtatcgattccatatcactggacggaaaaatctatggaattcctctggacagaggcggatatggcttctattacaacaaaaacatgctggagaaggcgggagtgaagccggaggatttagatacgatgtcgggagttttagaggcctgccagaagataaaggatgcgggaatggttccgctggcttccggttatgcggaatcctggacagagaatatcatcatcgagggccagacttttacgggaccgatggttgccgatccgatgatttttgagaaactgatgagcggggaaaagaagttttccgattatccggaatttgtggacattattacgcacggccagcagctggtccgtgattacgcgctggtagatgagaaggcggcaagccagcaggcgtccgaccagtatgcgcagttcggacgcggtgacgcagccatgatgatgcagggaacatgggcgatctccgatatccgaatcgcacagaaggcagcaggcaatacggatgagtttggatttacgtattatccatggtctgacgatcctgcaaagaactatatgccggccaatgccgatgactccttcatgatttcatcggggagcaagcacatggaagaggccatgctgttcgcagagtttgttctgacaccggaggcgggaaaagtatgggccaacgcatcgggctgtatcagcgctctctcgggcgtcagcgcggataatccggatccgcttctcacgatctttacgaaggtcctggacgaaaagggatactattttgagatgaatccgggcctggcgggccagtattaccaggattttgacaagatctacatcgagggaagaattgcggaggattctccggagacggtgatcgaaaagtggcagaaatcatttgacaatatccgggctacagggggctga

SEQ ID NO: 3151 - DNA, 1773 bp, Eubacterium siraeum
ataacgacagccctcattcgtgagggctgttttaatatcacgaccgaaagaggaaatatgaaaaaatctataatcagacgtgcgatagccgtgtttattgcggcgactatgcttgcaggctgtgcggcgcaggacagcggtgtattatcgtctgtcggaaacagctcggcgaccgaaagcaatatatcgtatgttgaggatacgagcagtgtcgatgaaaattccgaggttacttccgttgacagttcagtaacagagagcgacacatcttccgatacctccgaacaggaagaaagtaatacttcaaagcaggaaaatgcatcaaaggcagagaacaccgagaagcctgccgatacaacaaaggcaccgtcaactgccgacacgaaaaacaacagccagagcaagcctgcggcttcttcaagcaatttcactgttcagtggaagaagtcgagcagctgggaagaaggcggtaagaagtgcggaggttatgagattgttataaccaataacggcgatacggtgaacagctggacggcaaaggtgactgtccccggcaatacaaagctgatgtcgcagtggaacggaatattcagcatttctggaaacacaatgacggtcaagaacgagagctacaacggaactatagaaaagggaaagagcatttcgttcggattcaattattcggctgacgcttatatcaatgagggtaaagtgactgtgaacggaagtaccgcaggaacgagtgccggaaataacagcaacaataataacaatagcaataacaacaataataataatacgtcaacaatcaaaaagccggcggcaacagttcctcaggcgccgagcgaccctaaaggcactacgccggtatcacagcacggtcagctttcggtaaagaacggacagcttgtcgataagagcggcaagggttatcagctcagaggaatgagtacgcacgggcttacatggttccccgaattcgtaaacgagagcgcattcagaacgctccgtgacgactggaatacgaatgttgtccgtcttgcaatgtatgttgacgagtggggcaacggtcagtgctatatgggcaacaagagcggaagccttgaactgcttgaaaagggtgttgacatctgcatcaagctggatatgtatgttatcatcgactggcacgttcttaatcccggcgacccgtccaagtatacaaacgaggcgaaatccttctttgaaacggtgtcaaagagatatgcaaaatatccgaatgtaatttacgagatatgcaacgagccgaacggcggtgcatcgtggagcggtaatatcaagccgtatgctgaaaagataatacccgttatccgcaagaatgcgccgaactcggtaattatagtaggcacgccaacatggagtcaggaaatcgacaagccgctttcagatccgctgaactacaagaatgtaatgtatgcgttccacttctatgcggcaactcacgcaggacttcgttcaaacgtagaaaactgcgtggcacagggattgcctgtatttgtgtcggaattcggtacttgtgacgcatcgggcggcggtgcaaatgacttcaacgaaacgcagaagtggcttagctattttgacaagcaaggcataagctactgtaactggagtatctgcaacaaggatgaaacctgctcggtactgcggccgggaacatcggcaaacggtaactggagcgagagcgatctcaccgaaaacggcaagtggatgcgtaactggttgaagaagcactaa

SEQ ID NO: 3152 - DNA, 1095 bp, Eubacterium siraeum
ggtaagaaaatgtcaaacagattatttcagggcgtagttcatcagatgagagatactatcggtcgtgttatcggtgttatcgatgaaaacagtacgatagtcgcttgcagtgagctttccaggataggaacaaacagcgacttctttacaattgagcttggtgactcacatgatgtgttcatccgtgacggctatacatacaagcccttcggcgttcatgtaaagcccgattatgcggtattcatcgaaggtacggacgatcaggcggcaaagtatgcgtctatccttgctatctcactgtcaagcatcaagcagtactatgacgagaaatatgacagaaacaacttcgtgaagaatatcatccttgataacgttcttcccggcgatataacgctcaaggcaagagagcttcacttcaatgcggatataagccgtgttgtattccttataagtatcgtttccgcaaacgaggtttcggcttatgatgtaatacagaacctgttccccgataagaacaaggacttcgtgttcaatatcacagaaaccgaaatcgttcttgttaaggaaatcaaggcaggcatagacaacaaggacctcgaaaagctcgcacgctccatctcggatacgctttcgggcgagttcttcacaaaggtaaacgtaggtatcggtactcccgttacaggcataaaggatcttgcccgttccttcaaggaagcacagatagctattgaggtaggtaaggtgttcgatacggacaagactatcgtaagctacgataacctcggtatcgcccgtcttatttatcacctgcccacgaccctgtgtgaaacattcctgaaggaagttttcaagaagggctcaatagagtcgcttgaccacgaaacgttattcacgatacagagattcttcgagaataacctcaacgtttccgaaacgtcaagaaagctctttgtacacagaaatacactggtttacagactggataagataaagaaactcacaggtcttgatttaagagagttcgatcacgctatcatcttcaagatcgctcttatggtcaagaaataccttgccgcagatcccgtcaaattctaa

SEQ ID NO: 3153 - DNA, 945 bp, Eubacterium siraeum
gtgtatataaaacggcacaccaaaatcattcattattcattaaaagagataaagggcgcagggaaaggaacacaaatgaaaaccgaatttgttatagtaacgggaatttcgggtgcaggcaaatcctgtgcggtaaacgttatggaggatataggctatttctgcatagacaatatgccgcctcagctgataccgaaatttgccgagatatgcgaagaaaacgatgatatttcaaaggtcgctattgttaccgacattcgtggcggaactatgtttctgaacctcaacgccaccatagaggaactgaaaaagcgtggtcttgacgtaaaactgctgtttgtagatgcaaaccatcatgtagtaaaacagcgatataaggaaacacgccgcaagcatccgctttttgatgcgacaaacggcgacatagacaaggcaatagacgcagaaagggagataatcgagcctctgcgtgaaattgccgattattacattgacacaagcctgatgtcaacctctacgctgaaggaaaacgtgcttaatattttccttgacacgccgtctgacagtatgactataagctgtatatccttcggcttcaagtacggtgtgccgaatgaggcagaccttgttttcgatgtgcgttgcctgccgaatccgtattacatacccgagcttaaggaaaagtcgggacttgacaaagaggtaagggattatgtaatgagctttgaaagctcgcagactttacagacaaagctgttcgaccttatcgactttctgatacctcagtatcttcacgagggaaaaagccagcttgtaatagctttcggctgtacgggcggcaagcaccgcagcgcgacatttgcggaaaatatgtgcgagcatctcagcaaaaatcaccttaaagcaagggtgcttcacagagatgtgaataaggataagaagtaa

SEQ ID NO: 3154 - DNA, 735 bp, Eubacterium siraeum
atgccgaattttctgaaaggaaacaaaaaagtgagagaaagtatacttacaataccggtaaacgaagtgttcgagcctcgtgagggctgtcctatctgccgtatgagagatacggttgaggagcatatctgcgaatatataatgggagcggctatgatggagcctgacgtaagacaggataccaacaggctcggcttctgctttacacactatcagcagcttatgatgcagaacaaccgcctgtcgctcggtcttatgctcaacagtcatcttgaggagctgaggggcaatatttttgagaagaagggtttatttgcgcccaaggacgcaaaggctaaaaaggcaggcgcaataggcgatacctgctttgtctgctcaaaggtgcagtggggtattgaccatatgctcgaaacggtattcacaatgttcgcaaaggacggaaagttcaagaatctgttcaagtcgcaggaatgcttctgtatgcctcactaccactatcttgtacagatgagcgaagcaaagatggcaaagaacgacagagccgagttcataaaggctatggatacgataatgcaggaatatataacaaagctcaacagcgatgtaaacgacttctgcaacagctttgactaccgtaatgcaggcaagctccacagcgaagaaatggaacacgtccgcacatctatagaaagaagcgtttcgttccttacaggcagaaagccgaattcgaaataa

SEQ ID NO: 3155 - DNA, 738 bp, Eubacterium siraeum
ttgccggtaatcaaattggctgatttgaataaggatgctttgacctgtgttccgctccatgtcggatttatcatggacggaaacggcaggtgggcgaaaaaaagagggcttccgagaaaggcgggtcattcacagggtgcaaaggtattcaggcgcactgttgaggattgccgtgacatcggaataaaatattgcacattctatgcgttttcaacggaaaactggaaacgtccgaaggatgaagttgacgccataatgaagctgcttgtaaaatatcttgacgatatacgcagtatggctcagaagaatacaaggataatctttctcggggataagtctgcgtttgatgatgacatacaggcaaggcttgtcgagattgaagaaatatcaaagaataatgacggtctgtatgttcttgtagcgctcaattacggcggtaaggatgagatactgactgcggcaaaacgtcttgcaagggattataaagagggtaaggtcgatcttgacggctttacggaagacgattttgacaattatctttatactaagggcattcctcctgtcgaccttattataaggccgagcggagagcagagaacctcaaacttccttatctggcagggagcttatgcggagcttttgtttatggatgttctgtggccggatttttcaaagaaggatcttattgcggcttgcgacgagtacgcaaggagaaacagaagattcggcggactgtaa

SEQ ID NO: 3156 - DNA, 1479 bp, Eubacterium siraeum
atgaagaaaaatactaaaataatactcggctcggtaatcggcattgcggtactcggtgcggcaacgctcgcactggtgctgacacagccggagagcgacaacgcagactctggcacgtcaagcagcgaaaccgtcagcgtgaccgattatacgaccgatgatatttcaacgctcacgataagcaacgagagcggcgaatatacgataaaccgtttaggtaaggaaaagtggggcatagattcaatccccgaggcacttgcaaacagcagtgcatattcaaccgcaatgagcagtgccggcggcatcggcgcaaagcaaatcgttgaggaaaatgcgacagatcttgcaaaatacggctttgataagccgaccgcaacggttaaaatgacattcaaggataacaaggctgaggatataacctgccttatcggtataaagtacgagggcgaaaactcgtggtacgttaaaaccgacaagagcaatacggtataccttgtagcaaatgcaggcgtcagctttgcaatgaacagcgaactgtcatacgtcaacaagtcaacgcttacagcggcttatgattccgagaatgataaagtaaacagggtccgcatcgagcgaaaggatctggataaggatatagttcttgacaagctccccgaggaaaccgaaaaggagttttcgtcaacatatgttgcttatgaaatgtccagccacaacaatatccttgcagacgatgagcttgacaagaaagtgattttcggcctgttcggaatatcggcttcggatgtgtttgccgtatctcccacagacgagcagaaaaagcaggcgggtcttgacgatccgaactgcaccgttactatggtaagcaacaaggaaaccgttaccaagctcactttaggctctgctgtctacactgttacaaagaacgatgaaacaggcgaagagataaagacgataacgggctactatggtatgctctcaggcaaggacgcaatatatgtgttctctcccgactctctgccgtggcttaccgcaacacccgaaaatatgctttataagctgttccttacaccttatatctattatcttgacggtgtaacaatctatgacagcgacagaaaggcatatgatttcactattacgggcgacgctgacaagtcgagcttcacatacgaaggcaaggaggtagattcagccaagttcaaggcattctatcagtatctgctttcggcatacgcagagcagatttaccttgacgatcttacaggtgacaacaagttcatcgcaggtgtcacctacgatcatcgtgaagaaggcaaggaaaacgacgttgtcgagttctatgcgagcgagagcgaccgtacctgcattatcgttgtaaacggcgatgtccgctacaaggtaaggcagatatatgcgacaagacttcttgaaaatctgaatgcgcttctctccggcggagagatagtatcagagttctga

SEQ ID NO: 3157 - DNA, 864 bp, Eubacterium siraeum
aagaactacaagatggtaaccagaatagtgaccgcactggtagcgataccgatcggtattttaataatagcacttaacaacgaggtactttactatgttgctatgacggctttttctgtcatagcggtatatgaaatgttagttacgaccaaatatctgaagaataagttcacatcagccgtaagccttatatttgcggcagtaacacctattattttctggatagaaccgctcaggaacaacgtaaagctgatttacttcggctttgttgtaataatgctcctcgggatgctgttcaatcacgagaaggctcgatttgagcaggtcgcacttgttgcgtttgtatcgattacgataccccttgcgctctgctcgatagcatttatacgctcaagattcccggatcacgctatgttccttatagtttatactatggtgagcgcatgggtgggagatgccggtgcgtattttgtcggaacgtttttcggcaagcataagatgtgtcctgcgataagccccaagaaaacgtgggagggctttgtcggaggtataataacatcgggcgtttttgcggttataatgagctttgcgtatgagcttatcgacagcataataaacggcggagtgcatacattcagcgtgaactgggtgtatctcactgttatggcgcttgttatatcgggactcggcgtagtcggagatctttctgcgtcacttgtaaagcgtgaatgttctgtaaaggatttcggcaatatattacccggacacggcggtattcttgaccgtttcgacagtgttctgcttgccgcaccgtttgcatatatgatgttccagatatacttccccataaccccaatagcataa

SEQ ID NO: 3158 - DNA, 978 bp, Eubacterium siraeum
atgaaggctcgttgcttgcaagaatactcggagggtgctgaaatgaataaagaaaacatagttacattgaaatcgccttaccgtgatgattttcagataaacggatacagattcggtaagggtgaaaaaacctgttgtatagtcggtgcaatgcgtggcaacgaggttcagcagttatatgtatgctcacagatcataagagccctttcaaatattgaaaaaaagggcgatttggtttacggtaaacagataatggtcatcccttcgctgaatccgttttcgatgaatatccagcgccgtttctggtctgtagataataccgatctcaacagaatgttccccggtgacgcacacggaaagaccacacagagaatagccgcaggcatattcgattttataaaggaatatcagtacggcattcagtttacctcattctatatttccggtgactttatacctcatgtaagaatgatggataccgagcataagaacataggacttgcgaatttattcggtcttccgtatatacttctcagaaagcctaagccgtttgacacggcaacactgaacttcaactggcagaactgtgatacgagcgcattttccgtatatacaaacgaaacagagcatattgacgaagaatcggcaaatatagcggtaagcgctgtactgcgtttcctgtcgagaatgggcgtcataaagtatcagagccacggcggttatatggcaactacgcttgaagaagagcatctgatgtcggtacacgctaaaagcggcggaatatatcgcaggataaaacagcccggcgacgaggtggagcagggagatgtaatggcagagatactcgatccgtttgaaggcacggtcaaggaagaaatcaagtcgcccgcaaacggaattgtgttctttgcacataaatcaccgctcgtgcttgaaaactcggtcgtttataagataatcaaaagattgcatatctga

SEQ ID NO: 3159 - DNA, 1074 bp, Eubacterium siraeum
gcggacaatcttatcgaggactttgacggcacaaactgtgcgggctggtcaaacgagcagatgatggattatatccgtgaaaaaggcatcacctgccccaactgcggcaaggctgatttcacagacataagacagttcaaccttatgttcaagacattccagggtgttacagaggactcgaagagcgagctttaccttcgtcccgaaacagcgcagggtatcttcgtaaactttatgaatatccagcgtactacccgtaaaaaagtgcctttcggcgttgcacaggtaggcaagtcattcagaaatgagattacgcccggcaacttcatcttccgtgtaagagaatttgagcagatggagcttgaattcttctgcaagcccggcacagaccttgactggttctacttctggaaggactactgcaagaagtggctcctgtccctcggcataaacgaagaaaacttaagactgcgtgatcacgatcaggaagagctttgcttctactcaaaggctacaaccgacttcgaatatctgttcccgttcggctggggcgagctttggggcgttgcggacagaaccgactacgaccttacacagcacatcaagacaagcggtcagaagatggaatatttcgatcccgaaacaaatgagaagtacgttccttatgttatcgagccttcactcggtgttgagcgtctgttccttgcagttataactgaggcttatgacgaagaacagcttgaggacggtacaacaagaaacgttatgcacttccacccctacttagctcctgtaaaggcggcagttctgcccctgtcaaagaagcttgcagacaaggcgggtgagattgcagacgagctgtcaaaatacttctgcgttgattatgacgatgcaggcgctatcggcaagagatacagaagacaggacgagatcggtactcccttctgcatcacatacgacttcgacagcgttgaggacggttgcgtaacagtccgtgagcgtgactctatgaagcaggaaagaatgcctatcacagatgtaaagaagtacatcgaggacagaattgcgttctga

SEQ ID NO: 3160 - DNA, 1164 bp, Eubacterium siraeum
atgacagcttttcttttgcccgcaaaacaaaaaaatccccgttgcttgtcattttcttccggacacggacatataattcttcagatgaaaaagcgaggaggatttattatgttcgttatgactatgaccaagcgtaagctgatccgtgcggtcatgtttgtgttagtgctgattaccggcatcgctataggcgtattcgccatactctcgtctatagataccggtgcggaaaacgtaaagctgccgatatataacgtaaaacgcaccgacaacaaaatcagcattacgtttgactgtgcgtggggaaacagcaacaccgacaagctgatctcgatacttgccgaagccgatgcaaaggctacattctttgttacgggcgaatttgcggataaatatgccgacgatataaagaagctcagcgatgcaggccacgagatagcaaaccacagcgacaagcatccgcatatcaagggtatgaacgtaaacgacctcatagcagatacgaaggaatgctcacgcaagataaagatgataacgggcaatgctcccacgctttaccgtgcgccctacggagaatatgacgacaaggcggtaaccacgcttttcggaatgggaatgagcgtcattcagtggaacaaggacagcatagactgggataagccgacccccgaaacaataatcgagcgtacaacaaagaatatttcgggcggctcgatactgcttttccataacgaccttgaaaacacgactcaggcactgccgaccgtgcttaaaagtcttaaggaacagggctttgagctttgcaccgtgagcgagcttttgcttgagggagattatactatcgactcaaacggaactatgatgccgaaaagcaaagcaacggtaaatccgataatttacagcgataatcacgatgcgaatctggcgtttgaaacgcttgccgaaaagctgagcataagcgatataaacgcattgcagagcaaggacgtttcgattgaaaccgcccgtaaattagcgtcatatcttacgcaagagcagatagcggcgctgaaggcacttcccgaagaaagcctttacaacggctttgaaaagctgaaagaggcagtatatgcccgtgaaaacgccgttccgggaagctctaccgagccgataatcaaagactga

SEQ ID NO: 3161 - DNA, 1866 bp, Eubacterium siraeum
atgcccaacattccacagattacggctcctgtttccaacagtaagagctattcgttcactaaccggcagtatgacggtaatatagaaccgtttgatatggtcgagcttgctcagcctatcaaagcatctacggcgcaggataacgattccgccgccgctatgatgatgggcagaaagaatctcgctccgcttactgttcagataaaagatcccactatggcggtcgaaacgctcaagaacctgttaagttcggatctgctcgagcagacgatgatcaacggttacacagagctttacgacgatatggatgagcttatcaagagcttttatcttgctcccgaaaagctggtccgtgagattcagaaccaggaaaagcagaacacgatgttcagcggtgatgagttttacaagctgctccacggtatcctgaagaccaccacaagccccgatataaaagaaagtatcggtcagctactgaaagcgctcaactattcgtcaaacaagcaggagatacttaatgcactcggtgcaaatctcaaattcctgtccgaatatttttcaccgaacgagtcgctctcccgcaagctctccgatttgtcttcacaatggaagagcagtagtgcggctgatatgttcgagccgctcaagagtgaaacgctcgcactgctgaaggacgtttccgcaagtcttctgaacgatgaaagaacacagacgttcattccgctcataatacataatctttcacgctacaacaccaacaacggtatgctcaaggagagctttgcaaatctccttgcatatattccgtctgacgatatgcgtagggaactgtctgttgcatttggaaatcttcttaaaaagattttcagcaaaaaacagctcagcgagatgtcggatattcctgatagttataataatacactaaatcagtccgaaaatcaagactatttaagcatttttgacaataaagctgaaaaattatctctgtctttgttcattaagtcgcatttatccgatgaaagctatcttgcggagctggatttatctagggataagctggaatttctgacatcgccgtttgatgaaggaaaacaatccggattgcagacacttaagaatataataatggcgatgctgacaggcactgacagccgacagattattccagcggtgcatcgtgattttcagggaatcaaggatatggcggcacttgttgactatctcaacgagattctccgtgaaatgccggatatacctcagcgtgacacgctttttgagtttttcaccaatatagtaaacgagatggcacagcgtaaggaactgccgccttcgagcaatatcccttccgcaccgtctactcttgataagctgaccgattttatcggtaagaatataaatcacgaggctattcagtcgctggacgatttcaatgcgtcaaatcttctgcagagccttctcaatgcaccgggtgtattcacgcctcttgcacactatatcctgccgttgcagattgaggatacaaaggcattcggcgagctgtgggtcgataatgacgagaataatcctaacaacacgcctgtcggacagaagaattatcacttgttcctgacatttgacgttgaatctataggacgttttgaggtcgatatgtacgcactgggcgaaaacatcaatctgtcgcttctttatccagaaaagttcggcttcaagataaaaaagcttagcgataagattgaccttataataaggaatatcggctataagcccgcaaaatttgaaactgcggtgctgagaaagcctcatgtgctgacagaggttttcccgaaaataattgacaggaggaagggtcttaatgtccaagcgtaa

SEQ ID NO: 3162 - DNA, 1326 bp, Eubacterium siraeum
gtgtataacagggtatttaacgctgatgtaaaaggaaggttaaaaatgaacagttattcaatagaaacgcttgcggttcacgcaggctacgaaacagacgaagctacaatgtcggtaactccgcccctgtacgaaacaaatgcctatgtgttcaaggatgccgaacacgcaagaacgctctttgagcttaaagagcccggcaacatctactcaaggctccagaatcccacctgcgatattcttgaacgtaaggtaacagctatggacggcggtgttgcggcactctcgtttgcgtccggacatgccgctatattcaatactataataaacctctgcagtgagggtgacgagcttgtttcgtccataaacatctacggcggtgcgataaacctgcttggaatcacattaaagagaatgggcatcacggtaaagttcgttgaccccgatgacctttccgcttgggaaaatgccgtaaccgacaagacaaggctgttcttcaccgagcttatcggcaaccccaatgcaaacgtagcggatattgaggagatcggcaagatagcccacaagcacggcatcccgtttgtagtagacagcaccttcacaacaccctatctttgcagacctatagattggggcgcagaccttgttatccactccgcaacaaagtttttgggcggtcacggcagtgtaatggcaggcgttgtagtagacagcggaaagttcactttcaagggcaatcccagattcccgcttttcaacgagcctgacgtatcctatcacggtgtagtgtttgccgacctcggagaaatggcgttcatctcaagactccgtgcgctcataacaagagatataggcgcctgcctttcagcgtctgcggctcatacctgccttacaggtatggaaacgcttgctttgcgtatgcagcgccattgcgaaaacgcacttgcggtagcaaaattccttgaagcccaccctgccgttgaaaaggtaaattatcctgcactgccctcaaacaagtattacgagctttgcaaaaagtattgtcccaagggagcaggcggtgtgttcacattcgttatcaagggcggcaagcccgcaggcgagaagtttatgaacagccttgagcttttacagatagttgcaaacgtcggcgatgtaagaagtcaggttatccaccccgcttcaacaacgcacagccagttatcgcccgaacagctcgtagccgcaggaataagcgagggtacggtaagacttactatcggtatcgaggatataaacgatattattgcggatatttctcaggcgctcgataaagcgactaagtaa

SEQ ID NO: 3163 - DNA, 1821 bp, Eubacterium siraeum
ttggaaataaacgggcagaaccgtaggaaaggtatagattttatgttagacacaatgaaaggtcttaagcgcacacattattgcggcgaggtcgagggtatcggcagtaccgttaccgttgcgggatttgtacagagagtaagagataagggcagccttatgtttgtcgatctgcgtgaccgcacaggcattgttcagcttgtattcgatgatacaacagagcctgccgtatttgaaaaggcaaagcagataaagagcgaatatgtgcttatggcgcagggacttctgcgtgaaagagagagcaagaataacgatataaagacgggcaacgttgaaattctcgttaccgaccttcgtatactttcgatggctcagacaacgccgtttgagatagttaacgatacaaagacaaacgaggagcttcgtcttaagtacagatacctcgatcttcgcagaaagaagctgcaggataaccttataatgcgtcacaggatcgcaaagacagcccgtgaatatttctatgacaacggatttcttgaaatagaaacgcctatgatgatgaaatcaactcctgagggagcaagagattatcttgtgccgtcaagagttcacgagggcaagttctatgcgcttccgcagtcgccccagatatacaagcagttacttatgatctcgggctttgaccgctatattcagcttgcgagatgcttcagagatgaggaccttcgtgctgacagacagcccgaatttacgcagatagacctcgaaatgtcatttatggatgttgacgagatacttgagcttacagagggcttcatcaaaaagctgatgaaggatgtgcttgatgttgatattacaactccgctccccagactgacatataacgacgctatgtcacgttacggctcggataagcccgatacacgcttcggtatggagatacaggatctgtccgatattgtaaaggacacagagttttcagtattttcttcggctattgccgcaggcggcagtgtaagagcgattgtagcaaagaatgccgcaggtgttcttacaagaaaggaaatcgacaagctgaccgagctctcaaagggtatcggcgcaaagggtcttgcatatatccgctggcatgatgatgcacctaactgttcgtttgcaaagttccttaaagaaggcgagcttgacgctatcctttcgcacctcggctgtgaaaagggagacgtagtgcttatcgttgcggacaagaataaggttacactccccgtactcggcgctctgcgtcttaaggtcggcaagcagataggcatagtacccgacagcggatacaacttcttatggattaccgagttcccgttcttcgagtgggacgatgagtcggaaagctggcttgctatgcaccatccgttcacgatgcctatggaggagtgccttgagtatcttgataccgacaagggcaaggtaagagcgaaggcttatgaccttgtactcaacggcatcgagctttgcagtggttctatccgtatcacagaccccgagcttcaggagagaatgttcagacttctcggtcttaccgataaggagattgaagaaaagttcggcttccttgttgacgcatacaagtatgccgcacctccgcacggcggtcttggtataggtcttgacaggctttcgatgctcctttgcggtgcagacagcctgagagatgtagtcgctttcccgaaggtaaaggacgcaagcgagcttatgtcgcagtgcccgtcggtagttgacgataagcagcttgaggagcttcatatcaaaacggtggtttcagaagaataa

SEQ ID NO: 3164 - DNA, 1092 bp, Eubacterium siraeum
tatgagtgcttaccggccggaaacagcggagtgccgctgaaagaagggaaaaggaatatggaaaaccgtacactcagaatccttgaagcgatagttgacgaatatatacgcaccggcgaggcggtcggctcaaagctgatagccgaaaagctggataatgcagtttcaagtgcaactataagaaatgagatggcggctcttgaacagcagggctatcttgagcatacgcacacaagctcgggacgacttccgacatatcagggactgaggctttatatagaaaaggtaatgtcgcccgcacagttacccgatgaagaaaaagaggagatagaccgtatatttgataatatcggcggagcgaccgatgacgagataatcgacaatgcgtcaagggctcttgcggatattacgaaatgtgcgatagtttctaccaacaccgtaaacaagttttcggtaataacaaaggtagacgttatccccacaggcaaaagaatgtatgttcttcttctgataacctccgagggcaatatcagaaacagggtatgcaggctgagttttgatcttacaaacgagcagatggatttcttcacgcagtttgtaaacgagaacctcaaaggcgtaaaccttgatgagctgtccgatgaatatatagataaactgacgcaggcaatgggcggatatatgatgacgttatcgccgcttctcaaagcggtagtcgatatatcggctgaaatgcagcagcaggtagagttcagcggagaaaagaatctgctgacctgttctgatttctcgaacactcagatagcaacgatacttgacggcaagaacgagctttgcagctggcttgacgatacgttctcaggcatacagataaagttcggagccgaaagcgatacattcgccgttaccaattccagtctgatagcggcaagcttcaataaggacggacgaaaggcaggttctttcggagttataggtcctgtaagactggattacaaaaagctgatcccgtatattgaatatttctcgtcaaaggtcaccgatgcactgtcggcaggcaatgacgaagaagaaaagaacgaagaaaaggag

SEQ ID NO: 3165 - DNA, 1371 bp, Eubacterium siraeum
atgtgtggaaagagtataaaaggagagaatagtatggcagttacacttaacgacaagtatcttaagggtgttgtaaacgccgatgagcttaagggcatggagcctatggtaaaggtcgctcacgagatgatcgaaaacaagaacggcttaggaaacgactttttaggctgggtagatcttcccataaactatgacaaggaagagtttgagagaatcaagaaggctgcggctaagataaaggctgacagcgaggtgcttattgttatcggtatcggcggttcttacctcggagcaagagcggctatcgagcttttaagaagcacgctttacaactcgctcgctaaggatacgcccaagatattcttcgcaggaaacagcataagccctacatatcttaatgaagttatagaacttgttaaggacaaggacttctctgtaaacattatatcaaagtccggcacgacaaccgagcctgcactcgcattcagagtattcagagaaatgctcgaagaaaagtacggcaaggacggcgcaaagggcagaatttacgcaactacggacaaggcaaagggaacactcaaggagcttgcagacgctgagggttatgaaacattcgttatccccgatgatgtcggcggacgtttctcggtacttacagcggtaggtcttcttcccatcgcttgtgcaggctgtgacatcgatgctcttatggcaggtgccgcaaaggcaagagaggacttctccgtatgcgatattgaaaagaacgattgctacaagtacgccgcactgcgtaacgtacttcgcaacaagggctacaaggtagaaatgctggtagcttacgaaaactcatttgctatgatgaacgaatggttcaagcagctgttcggtgagagcgagggcaaggacggaaagggtctgttcccggcatccgctacattctcgacagaccttcactcactcggtcagttcattcaggacggctctaacattctgtttgaaacggtagttcatatcgcaaaggctcagaaggatttcttcttaaagaatgacgcaacaaacggcgacggactgaacttcctgtcgaatcagaatatgtcggtcgtaaatcagaaggcttatgagggtactataatcgctcataccgagggcggcacacccaatatggtgcttgaaatgcccgaagtaaacgagagcgagcttggctatctcatctacttcttcgagaaggcttgcgcagtatcaggctatctgctcggtgtaaatccgttcaaccagcccggtgttgagagttacaagaagaatatgttcgcacttctcggtaagcccggctatgagaacgctaaggcggcactcgaagccaagataggctaa

SEQ ID NO: 3166 - DNA, 1296 bp, Eubacterium siraeum
atgagctatacatatgataacaactacagatttgagacaatccagcttcacgcaggacaggaaactcccgaccccgcatcagacgcaagagcagttccgatatatcagacaacatcatacgttttcaagaacagcgcacacgctgctgcacgtttcggtcttgctgacgcaggcaacatctacggcagacttacaaactcaacacagggtgcttttgaaacaagaatcgccgctcttgagggcggtgttgccgcactcgctacagcatcgggcgcagccgctataacttatgctattcaggctctcgcttacgcaggtgagcatatcgtagcacagaaaacaatctacggcggcagctacaacctgcttgcacatacgcttccccaatacggcatcagcactacattcgtagatgcacataaccttgaagaagttgaaaacgcaattcaggataacacaaaggctatctatcttgaaacgctcggcaaccccaacagcgacatccccgacattgacgctatcgcagagatagcacacaagcacggacttccgcttgtaatagacaatacattcggtactccttaccttatccgtcctatcgagcacggcgcagacgttgtagtgcactcggctacaaagttcatcggcggtcacggaacaacgctcggcggtgttattgttgactccggcaagttcgactggaagaagagcggtaagtacgctcccatcgcagagcctaaccccagctatcacggcgtatcatttgtagatgctgtaggtcctgccgcattcgttacatatataagagcaattcttctgcgtgatacaggcgctacaatttcaccgttcaacgcattccttctcttacagggtacagaaacactctcattaagacttgaccgtcatatcgagaacacaaagaaggtagtagaattccttgctaatcaccccaaggttgaaaaggtaaatcacccctcactgcccgaccaccccgaccacgcactttatacaaagtatttcaaaaacggcggtgcgtctatcttcacattcaacatcaagggcggacaggaagaagctcacaagttcattgacagcttacagatattctctctgctcgcaaacgttgcagatgtaaagagccttgtaattcaccccgctacaacaactcactcacagctgacagatgaggagcttgcagaccagggtataggcagaaatactatccgtctttcaatcggtacagaacatatcgacgacatcatcgccgatctctcgcaggcatttgataaagtctaa

SEQ ID NO: 3167 - DNA, 1209 bp, Eubacterium siraeum
atgccgagctttacaattcacagtttgtcagctgataacgctgaggcttggggctttatgaagaatttgcaaaggtgcaaagcagaaatgttttgtgccttttgctttttgcccggagaattaatcgcaaatcgtgctgtttcgctttatacagcaataaaagcaaaacagatattctgccgtaaaataaatttacctgccttattgtttccaaccttgacaatgaatttaaaagggaatatacttatatcaacgacagatttcggaggtgtctatttgttacaggacgttgtatccgtttcactccctgtgaatgagcggatgatgataaaaaagaatcattttgagccgtacaaccttacaggcagcgaaaagcgtatatgtatagttacaggtattcacggcgatgagttggaggggcagtacgtttgctatgagctgataagaaagctcagcgaaaacaggcatttgctcagcggtatagttgatatatatccgtctatgaatccgctcggaatggattcgataaagcgagagatgccgatattcgagcttgatatgaatatgatttttcccggctcggaaaccggtgcggtggctgagcatattgccgccgctattatgaacgatataaagggtgcggatatatgtatcgacatccacgcaagcaatatattcctgcgagaaattccgcaggtgcgtatttcggaagaaacagcgccgaagctgttgccctatgccaaaatgctgaacgttgactttatatgggtacattccagcgtcactgttatggaggctactctctcgcacagccttaacaaagagggaacaccgacacttgttgctgaaatgggtgttggaatgcgtataaccaagtcttatggcgatcagctccttgacggaatattcaacctgatggctgagatgggtatatggacaggcgaaacgaagaaggtttctcatcctattgtttccacagacggaaatgtatcattcatatattcggatacatccggtatttttatgcccgcaataaagcactgggcaggaatatccaagggagatcatataggcgatatactcgatccgctttcgggtgctgtcgaacaggaaatattcgcaccttgcagcggtattgtatttacgttgcgtgagtatcccgttgtatatgaaggctcgttgcttgcaagaatactcggagggtgctga

SEQ ID NO: 3168 - DNA, 1095 bp, Eubacterium siraeum
atgaaacttggaatggtcggtctgccgaacgtaggcaaaagtaccttattcaatgcacttacaaacgcaggagcagaatctgcaaactaccctttctgcacaattgagccgaatgtgggaatagtatccgttcccgatgaacgtcttgacgcactcgctaagatgtacaaccccgaaaaattcacacccgcaactctcgaattcgttgacattgcaggtcttgtgaagggcgcatccaagggggaaggactcggcaacaagttcttgtcgaacatccgtgaggttgacgctatcgttcacgttgtgcgttgcttcgaagatgacaatatcattcacgttgacggcaaaataggtgccgcaagagatatagaaacaattaaccttgagcttatcttctcggatattgaaataatccagcgcagaattgacagagaaaagaagcagatgaagggcgacaagagccttgcttccgaagttgaattcctcgaaaagctgctggctcaccttgaagaaggtaaatctgcaagatcgtatccttataccgaatccgaacttgaaatggtaaaggcttctcccctgctgtcgaacaagcctgtaatatatgccgcaaatctttcagaatccgatttcacgggcgatattgaaaagaacgagcagtacagagcggtttgtgaaatagcaaaggctgaaaacagcgttgtacttcctatctgcgcacagattgaggctgaaattgccgatatgtcggctgaggataaggaaatgttcctgtccgaactcggtcttaaggaatccggtcttaaccgtataataaagcagggctacagcctgcttggccttatatcttatcttaccgcaggcgttcaggaggtccgtgcatggactataacaaacggcactaaagctcctcaggcggcaggaaagattcacaccgactttgaaaaaggatttatcagagcggaaatcgtttcgtttgacgatcttatggcttgcggcagtatggcggcggcaaaggaaaagggtcttgtccgtcttgaaggcaaggactacgttatgcgtgacggtgacgttgtactgttcagattcaacgtataa

SEQ ID NO: 3169 - DNA, 855 bp, Eubacterium siraeum
tatagagggataaccgttatggtattgatgcttctcgttgtcgcctgctacaccgtctgcggtctcagcgacaaatactccgtcgcaaagctgaagtttgacggcaattcgttcacttttcttatggctttgcctacagcggtgcttttactgccgcttatgcccttttccgatatgcacttacagctttgctggcagtctgtgcttgcggctgttcttattatggtgtcgaagctgcttgaattcaagatgtctgcacttgtgcttaccgagatgtctgcattcgagcttaaggcgtggctcggtctttgcctgtttgcgtcttatgcgaccgatataataaccgctacggatacattcagcgttttaaaactactggcgatagttgtcactgccgtaggactttttatgatagcacggtcggaaagagagcatatcagctataagaaaatagctgtaccgctgttcttctatctgctttcaaagttcggctacggctttattatcactgcgtctgcgccgtacatatcctcatactttgccctgcttttcggacttatcctgcttgccgccgtgcttgtgcctttcgttcacccgataaagatgataaaagacaagccgaagggctgtgcatttgtagcgctgaccaaaataccgaacgcactcggacttgtgcttgaaaatgccgttatcgccacaagtatgaccaactattcattcatacagcctatgataatggtagcgcttttctttatcggtcttatccgtaaggaaagcacaaagccgctcaatatcatcggcagtattatctgcataagcggaattgcggcatttcagattttcgggcttatataa

SEQ ID NO: 3170 - DNA, 864 bp, Eubacterium siraeum
atgttagtttctgcaaaagaaatgctgaacaaggctcttgagggcaagtacgccgtaggccagttcaacataaacaaccttgaatggacaaaggctatccttcttacagcacaggagtgcaactcacctgttatcttaggtgtttctgagggcgcaggcaagtatatgtgcggttataagaccgttgtaggcatggtaaagggcatgatcgaagaactgaacatcacagttcctgtagctctccaccttgaccacggtactttcgaaggtgctaaggcttgcatcaacgcaggtttctcttctataatgtttgacggttctcactatcctatcgctgagaacatcgaaaagacaacagctctcgtaaacacttgcgatatactcggtatctctcttgaggctgaggtaggctctatcggcggtgaagaagacggcgttataggtatgggcgaatgcgctgatcccaacgagtgcaaggctatcgctgatctcggcgttacaatgctcgctgcaggtatcggcaacattcacggcaagtaccctgcaaactggcccggtctttcatttgaaacactggcagcagttaaggagaaggttggcaatatgcctctcgtactgcacggcggtacaggtatccctgcagacatgatcaagaaggctatttcactcggcgtttccaagatcaatgttaacacagagtgccagcttgcattccaggaagcaacaagaaagtacatcgaagaaggcaaggatcttcagggtaagggcttcgatcccagaaagctcctcgcacccggctttgaggctatcaaggctacagttaaggaaaagatggaactcttcggatcaatcaacaaagcttaa

SEQ ID NO: 3171 - DNA, 1752 bp, Eubacterium siraeum
atgctaaaactggttaagtatcttaaaaaatacagaaaaaacgtaatactcggacctattttcaagctgaccgaggcggtatttgagcttatcgttcctctggttatggcgaagataatagacgttggtattgcaaacaaagacagcggttatatctggaagatgggcggagtgcttgttctgctcggtgtatgcggtcttggatttgcgcttatttgtcagtatgtggcatcggttgcgtcgcagggcttcggcacagagctaagacgtgagctgtatcatcatatcaacactctttcgcacaaggaggttgacgaattcggcacgccatcacttataacgaggcttacctccgatataaatcagctgcaggtcgctgttgcgatgctgataagacttgttgtaagagcaccgtttttggttatcggttcaacgataatggcttttatgatagatgtgaaattagcgctgattttcgttcttgttattccgcttgttgcgattgttatgtggcttgtcacaacaaggactgtccccttcttcaggtcgatacagaaaaagctggacaagacctcactcatcacccgtgaaaatcttgtcggtgcaagagccgtaagagctttttcaaagcagcagcacgaaatagaacgtttcaaggataacgctgaggatattgaaaaagcggcagtaagagccggcaagatttcagcactgctcagccctgtcaacgctattatactgaaccttgcgatcgttgcgataatatggttcggcggattctcggtaaatgtcggcgaccttacacaaggtcaggttatcgcacttgtaaactatatgaatcagatcctgcttgcccttgtggtagttgcaaaccttgttgttatattcacaaagtcggcggcttgtgcggcaagagtaaacgaggtacttgacacaaagccgtcagttacagaaacagacaacaccgaagaaaacggcgacagttctgctcctgccgtaaaattcgataaggtatatttcagctatcacgataacagcgaatatgcacttgaagatatatcattcaccgccgaaaaaggtcagacgataggtataataggcggtacgggcagcggtaaatcaacgcttataaatctaatcccccgattctatgacgcatcagacggtttggtcgaagtttacggaacagatgtcagaaaatacagccttaaccgtcttcgcaaaaagatagcggtcgttcctcagaaagctgtacttttcagcggtacaatccgtgaaaatatgaagtggggcggagataatataactgacgagcagatatggcgtgcgctgaaaatctcgcaggcttatgagtttgtcgaaaagcttgaaaacgggcttgattataagatacttcagggcggtaagaacctttcgggcggtcagaagcaaagacttactattgcaagggcaatagccgcagacccggagatactgatacttgacgacagcgcaagcgcacttgactttgcaacagatgcaaagctgagaacggcaatcaaggaaaactgctccgatatgacggtgtttatcatttctcaaagagcgaacacggtcaaaaatgccgatcagataatcgtgcttgatgacggtaaaacagtcggtataggcacgcataaagagctgttacagagctgtaccgattactgtcagatctgtcttactcagttcagtgcggaagaacttgaaaaggagataaacggcgatgagtaa

SEQ ID NO: 3172 - DNA, 2019 bp, Eubacterium siraeum
atgaaaaaatggcttgtcagaaatacggacaatgcacttgcaatgaaactcaagaccgacacgggactgccgatgcttttgtgcagtctgcttgtcggcagaggaatatacacagccgagcaggcacagcagtatttcaacggtacggagctttccgaccccttgcttattgcggatatggataaggcagtacatgcgatagaagaagcggttgacaatgaagtaaagataaccgtgtacggcgattacgactgcgacggtgttacatctaccgttatgcttttcacacatcttgatgcaataggtgctgacgtaaactggtacatacccacccgtgaagaaggctacgggctgaacgaaaatgcaatacgcaaactgcacgaggacggtacgggtcttataataacggttgacaacggcgtttcagccgtcaacgaggctgagcttatatatgaacttggaatgaagctggtcgtcaccgaccaccatcagctccctgagattctgcctaaagcggaggctatcgtaaatccgcacagacaagatgataactctccctataaagaacttgcaggctgcggcgttgcgctaaagcttattatggcactggaacgtgatgttgaaggtgttcttgagcagtatgccgaccttgcggctatcggcactataggcgatgttgtcgcactgacaggagaaaaccgcataatagttaagcgtggacttcttgaaatgcagtacagcgaaaatcagggacttcaggcgcttatcaatgcggcaggacttgatgccgaaagtattacttctacaggcatagcgttcggcttatgcccccgtataaatgccgcaggacgttatgacagtccgaaagcggcggcagagcttcttatggctcagaccggacagatagccgagataaaagcgcaggaactgaatgaactgaacgctaagagaaaacagattgaaagtgagattctcgaaatggcaaaggctcagcttattgccgaccctaaagcgttcaactcccgtgtgcttattgtttgcggcgagggctggaatcacggaattataggtatagtcagtgcaagacttcttgaactttacgaaaagccctgtatcgtcataggcatagagggcgatgaggcaagaggctcagcgagaagcatcgaaggtttttcactttataccgcacttgatgcgtgcagtgagtatcttacacgtttcggaggtcatacgaaggcggcaggcttttcgcttccgaaagacaaggtagatgattttatagctcagctgagaagctatgcggacgaaaaatttccttcaatgccggttatgacaacggaggctgatattgagccggagctgtccgaccttgaaatatcttcaatcgagaatcttcgccatttacagccctacggcgaagaaaacaacgctccgctgtttttgatgagaaactgcacaattatatcctcaagaccgctcaaagacggtaaatatacatcgtttaccgcagagtacaaaggctcacagtttaaatttctctgcttcggaacatcgtttgataagttcggatattatcccggagataaggtcgatgtgctgagccatattgaaataaacgaatataatgataaaaaaagcgtcagcgtaagagtaaaggacatacgcagaagtgattttccgcaggataagtattttgccgcaaggaatttctatgaaaaaatcctcagaggcgaaaaaaccgattcaagacttcttaaacgtatcctgcccgataaggagaatatgaagctcccgttcgaccttgcaagaaagctgacctctatagattcagccgcacagattgcaatgtcgcacggtatgaattactgcctttttatgatgtgccttcatgtttttgcggaattcggtcatcttgagctggacagaataaacggtacgatgaatttcataaaaggcggcagacgtatagagcttgaaaactcggcagtgataagaagaataatgaaatcctgcagctga

SEQ ID NO: 3173 - DNA, 990 bp, Eubacterium siraeum
atggcagattttatacagaagggaggctggaagatgcgaggcttaggcagacgctatctgctgcgcaggacggtaaaagacgcatttgataatctcccgtcgggtatatgctttttcgacagcaacggaatagcggttctgtgcaacaagcaaatggacaggctgatatatgaattgaaaggctttgacgtacagtgcctcagcgaactgcaggatatattttcggagcataacagcggctcggtcgtacttgtaaagggaaaagcatggcgcttcagacttgatgtggtttctcttaacggtgtcggctactatacgcaggtaactgcaacggatgtagatgagctgtacaaacgtcagcttcagcttgaagaaagcagcagaaaactcgagcgtgcaggcagacgaatgcgaaagctgacagagaatataagaacggttatccgtgaagaagaaatactcagtatgaagattcgtgtacacgatgatataggcaggagcgtaattgcgacccgtaatctgctgtcaaataacagaccgacaagcgagctggatcttacagcgtggaagaatgctgtaagacttcttgtgagggacaacgaaaaaagctacggagcaaacagctatgatatatccggtcagttaaaggaaacatcttccgttctcggaatcaaaataaacgttgaaggagatattcccgacccgttttattataaaatattcataacggctgtcagagagtgcgctacgaatgcggtacgtcacgcaggtgcgacaaaattgaacgtaaaatgcagtaaaagcggcggcagacaatggatagccttgtctaatgacggaaaagcaccggtcagcgccgtcactgaaggcggcggtctttcgtcactgcacgacagagtagaaaaaagcggcggaactatgagcattaattcatatccgtatttcgagcttgtaatttcatttccgctcaacaaggaggtaacactatga

SEQ ID NO: 3174 - DNA, 1278 bp, Eubacterium siraeum
atggaaatacaactactcgtaataatcataataatgatcgcctgttcggcgttcttttccgccagtgaaacggcacttaccggcgctaaccgcataaggctcaaaagcatggctgaaaacggctctaagggcgctaaaatggcgcttaaactgcttgacagatacgataaggttatcacaacaatacttatcggcaacaacatagtaaacataaccgcatcttcactgggtacaatacttgcgacagcaatagtaggtcctgacaatgcggctctggtatcgacagttgtactgacgcttgtgatactcacattcggcgaagtaatgccgaaaagccttgcgaaagaccactcggaagggatgacggtcgcaacgagcggaataatcacattccttacattcatattcactcccctgtcggctttgtttatactgcttaaaaagctcgcaaacaagctgttcggcaacaagaaggaggttaccgtaacagaacaggagcttatggctataatagacgaaatcgaggacgagggcgtacttgaagaacaggagcgtgaccttgtgaagtctgctcttgaatttgacgaaacggtagttgacgagataatcactcaccgtgtagacgtcattgcggtcgatgtaaacgaagatattgaaacagtaaaggaaaccttcatcaacgaggaatattcaagacttcccgtttacgaaggctctatcgaccatataatcggctttgtgagccagaaagactttttcaagaaatatcttactaaaaaagatgacgaaacgttcttactgcgtgatataatgcaggagattcactatgttcctcatctgatgaagataagcgatataatgaagcagatgcagaaggacaaggtacatatggctgtcgtactcgaccagtacggcggaacgctcggtattgtcacacttgaggatatacttgaacagcttgtcggtgaaatatgggacgagaacgatgagataatcgcccctgtcacattcgtatcggaaaacgagttcaacgtcaacggcgatgtatcgctgaccgctttcaagcgttactggcataaccgcactggtgatagtccgaaaatagacggcaacgcaaagaccgtcggcggctgggtgcttgagcttttcggaaaaatccctgaaacaaacgaaagcgttacaacagacgatttcagaataacggttcttaaagtcagcgaaagaagaatagtaaaggtacgccttaccgtaattcccaaatccgaaaataaggaataa

SEQ ID NO: 3175 - DNA, 3279 bp, Eubacterium siraeum
atgccaacaatacggcaaataaaaatttcgcactgcaaaagtgcggtaaggaagagaaatatgccaaaaagacaggacattaacaaaattatgataataggctccggtcctatcatcataggtcaggcttgtgagtttgactattcaggcacacaggcttgtaaagcactcaagaagctcggttacgagatagttcttgtaaactcaaaccccgcaactattatgaccgacccggatgtagcggacatcacttatattgaaccgctcaacctcgacagacttactcagattatcgagcaggaacgtcccgatgcgcttctgcccaacctcggcggtcagtcaggacttaatctctgctctgagcttgacaaggcaggcgtactgaaaaagttcaacgtacaggtaatcggcgttcaggttgacgctatcgaacgtggtgaagaccgtatcgagttcaagaatgcaatgaaggatctcggtatcggtatgccgagaagtgaagttgcttacacgattgatgaagctgtcaagatagccgaggaactcaagtaccctattgttcttcgtcctgcctatacaatgggcggtgccggcggcggaatggtttataatgtagacgaacttaaggttgtatgcgaaagaggcttgcaggcatctcttgtaggtcaggttcttgtcgaggaatgcatcttcggctgggaagagcttgagcttgaagttgtccgtgatgccgacaacaataaaatcaccgtttgctttattgaaaacatcgaccccatcggcgtgcatacgggcgactcgttctgctctgctcctatgctgactattcccgaagatgttcagaaagagcttcaggaaatgtcttaccgcattatcgaatccatcgaagttatcggcggctgcaactgtcagtttgcccgcaatcccgaaacaggacgtattgttgtaatcgaaataaaccccagaacatcacgttcttccgctcttgcttcaaaggctacaggcttccctattgccttcgtttccgccctccttgcctgcggtctgacgctcaaagatattccctgcggtaagtacggcacactcgacaagtattaccctgacggagattatattgtaatcaagttcgcacgttgggcatttgaaaagttcaagggcgcagaggataagctcggaacacagatgagagctgtcggtgaagtaatgagcatcggcaagacctataaagaagctttccagaaggctatacgttcacttgaaaaggacagatacggtcttggctttgcaaagaacttccacaatatgacaaaggaagagcttttagcacagctcagataccccacaagcgaaagacagtttgttatatacgaagcacttcgcaagggcgctactattgaagaaatccatgcccttacaaagattaaggactggttcttacagcagatgaaggagcttgttgacgaagaagaagcactgctcaagatcaagggttctgttcccgaaaaggctgtactaaagcaggcaaagctggacggtttctccgaccgttatttaagctcacttcttgaggttaccgaggaagaaatcagaaatgcccgtatcggcttcggcataaaggaagcgtgggaaggcgttcatgtaagcggtacggacaatgcggcttactactactccacctatcatcttgacgaggataaaagccctgtcagcgacaagcccaagataatgattctcggcggcggtcccaacagaataggtcagggtatcgaatttgactactgctgcgttcatgcggcacttgcgctcaaaaagctcggctttgaatctatcatcgtaaactgcaaccccgaaacagtttcaaccgactacgatacatcggataagctctactttgagccgctcacccttgaagacgttctttcaattcacgataaggaaaagccgctcggcgttatcgctcagttcggcggtcagacgccgctcaaccttgcaagcgaccttaagaaatacggtgtaaacattctcggcacaactcccgaaactatcgaccttgcggaagacagagatcacttccgtgctatgatggacaagctcggaatcccgatgcccgaatccggaatggctgtaaacgttgacgaagcacttgaaatcgctaaccgcatcggttatcccgtaatggtgcgtccttcatacgttctcggcggcagaggtatggagattgtgcacgatgatgaaatgatgaaggtctatatgtctgcggcagtcggcgttacccccgacagacctatactcatcgaccgttttctccaccacgcaacagagtgtgaggctgacgctatctcggacggcaagaactgctttgttcccgctgttatggagcatatcgagcttgcaggcgttcactcaggtgactccgcttgtatcctgccctctttgaaccttacggaaaagcaagtcacaacaatcaaggattacacaaagaagattgctgttgaaatgaatgtatgcggtcttatgaatatgcagtacgctattgaagacgatactgtctatgttcttgaagctaaccccagagcgtcccgtacagtaccgctggtatcaaaggtttgcaatataaacatggtacagcttgctactcagataatcacatcatcactgacaggcaagccctcccccgtacccgagcttcacgacaaggttatcaatcactacggcgttaaggaagcggtattccccttcaatatgttccaggaggttgaccccgttctcggtcccgaaatgcgttcaacaggcgaggttctcggaatcgctcccaccttcggagaagcgtactacaaggctcaggaagcaacacaggtaaagcttcctcttgggggaactgttctcctcagcgtatgcgacagagataagcccgaactgcttgaaatcgcaaaatcattcagcgagcttggtttccgtatccttgcaacaggcaagagctatgatatgataaaggacgcaggcatcaccgctgaacgtatcaacaagatgtacgagggcagacccaacatcaccgatgcaatagcaaacggcgatattcagcttatcatcaacacacccgcaggtaaaacgagtgcaaacgatgacagctacatccgcaagtcagcaatcagacataaggtgccttatatcacaacaatggcggccgctaaggcaagcatcgagggtataaagtcacttaaagcaaacaaacacttcggcgtaaagtcaattcaggcacaccacgcagatataaagtaa

SEQ ID NO: 3176 - DNA, 2772 bp, Bacteroides xylanisolvens
tgtattattaccttaaaaactaagaatatggtacaacacgctagactcattttctacagccttcttcttctggtaatcccgtgcgagggcacgtgggcacagaagattcccgtcgcgcccatagattcattgattaccgtaggatatgccaccggaagtttgaaaaccctgtccggttccgtagagaaaatcacggagacacagatgaacaaagaccagataacgaaccctttggaagcaatccgtggacgtgtgccgggattgaccatccagcggggctccaacggaccggcggctctggatgcggtgcgcctgcggggaactacttcactgaccagcggcaacgaccctttgattatcgtcgacggagtatttggcgacttgagtatgcttacctccatttaccctacggacattgagagttttaccattctgaaagacgcttccgaaaccgcacagtacggctcgcgaggtgcatccggtgtgatagaagtcaccaccaaaaaagggatgagtggcaggacacaggtggcttacaacggtagcttcgggatttccaccgtctacaagaatttgaaaatgctgtccggtgatgaattccgccgcgtagcatcggaacgaggcatttccattctggacaaagggaacaataccgatttccagaaagagattgagcagacaggactgcaacagaatcatcacatcgccttttatggcggttccagtgagtccagttatcgtgtttccctcggttttatggatcgtcagggagtgattctgaatgaagacatgaagaatttcacttcaaatatgaacatgaatcagaaaatgttcgacggcttcctgaactgcgaactgggaatgttcggctccattcagaagaatcataacctggtagattatcagaaaacgttctattcggcagctacgttcaatcctacctatcccaatcataaagaccccgtcaccaattcgtgggacggaataacgaccgccagccaaatcaccaatccattggcatggatggaagtgcaggacgatgatgccacttcgcacatcagtacgcacgcccgtctcactttcaatctgatggaaggactgaaactaagcctgttcggagcttatacttacaatatcgtagaaaattcgcaatacctccccacttccgtctgggcgaacggtcaggcatacaaaggaaccaaaaagcgcgaatccttattgggaaacatgatgctgacctataagaaaaactggaaaaagcatttctttgacgtactggcacttgccgaacttcagaaagagacttacacaggctattataccacagtcagcaatttcagcaccgataagttcgggtataataaccttcaggcaggagcgctccgtttgtgggaaggcactaattcctactacgagcaaccgcgcctggcatctttcatgggacgcttcaattatacatacgccgaccgctacgtactgacgttgaacgcccgtacagatgcttcctccaaattcggagccaaccataaatggggctttttcccctctgcgtccgcggcatgggtgattagtgaagaagaatttatgaagcaattccccgtgatagacaatctgaaattccgtatcggttacggtctggcaggtaaccagagcgggattgactcatacacaacgctgaatctcgtcaagccgaacggtgtcgtccccgtcggaaactctgccattgtatctttgggagatctccggaatacgaatcccgatctgaaatgggaagtgaaacatacctttaataccggtttcgacatcgctttattcggcaaccgcctgttgctttccgccaactattacaactcccgcaccacggatatgctctacctttacaacgtaagcgtgccccctttcacctataacaccttgcttgccaatatcggctccatgcgcaactggggtacggaaatcgccatcggtatcacccctttgaaaacgaaggacatggaactgaatatcaatgccaacatcacctttcaacgcaacaaactgctttcattgagcggtatgtataacggcgaaatgctttccgcttccgaatataaaagtcttgccagccttgatggagccggcttccacggcggctacaaccacatcgtttatcagatggtggggcaaccgttgggcgtgttctatcttcctcacagcaccggactggagtccgacggaaacggtggatatacctatggcattgccgacctgaatggcggaggcgtcagtctggaagatggtgaagaccgctacgtggcagggcaagccgtacccaaaacgattctgggatctaacatcagtttccgttacaagcgtttcgacctgtctttgcagatcaacggagctttcggacataaaatctacaacggaacttccctgacctatatgaacatgaatatattccccgactacaacgtaatgaagaaagctccgcaacagaacatcaaggatcagaccgccaccgactattggctggaaaagggagattacgtcaacttcgactatgtgacgctgggctggaacgtgccgattgaaaaggtgcagaaactaaagaaatatgtccgttccctgcgcttggcatttactgtcaacaatctggcaaccatctccggttattcgggactttcgcccatgattaacagttccacggtgaactcaacgttgggcgtggacgataaacggggatatccgttggcacggacgtacaccttaggattgagtattaacttttaa

SEQ ID NO: 3177 - DNA, 2547 bp, Bacteroides xylanisolvens
agaagaaaaggaaaaagtatgaataatcaattctcacaaagagtttccgacattatcgtctatagtaaggaagaagcgaatcggttgagaagtaggtatataggccctgagcacctgcttctgggaatccttcgtgacggtgaaggaaaagctatcgagatattgtctaaactcaacaccaatctagctgcaataaagcaacagattgaagctcaactgaaggcagaagctgatgatatgttattgcctgatgcagaggtaccgttatctaatgatgcggcaaagatattaaaaatgtgtattttagaagctcgtggaatgaaaagtaacatcgctgatacagaacatgtattattggctattttaagagaaaaaaacaatatggccgcttccgtacttgaagcaaacgatataaattatgtgaaagtactggagcaagctacattgcaaccagatataaactctggcatgggctttacggaagacgatgatgatgacgaagaaatgtcctctccccgttccggcagaggtggttcggacgaacgccaacaagcacaaaccgcttctaagaagccgtctaatgacacaccggtacttgacaatttcggtactgacatgacaaaagcggcagaagaaggacgcctagatcccgttgtcggcagagagagagaaatcgaacgtttagcgcagatcttaagccgccgcaaaaagaataatccgattttgattggtgagcctggtgtaggaaaatcagcgattgttgaaggtcttgcattaagaatcattcagaaaaaggtttcgcggattctgtttgataaacgagtggttgctcttgatatgactgctgttgtagcaggaaccaaatatcgtggacaatttgaggaacgtattcgttccattctcaatgaattacagaaaaatccgaatgtaatattattcattgatgaaatccacacgattgtaggcgcaggctctgcggcaggttctatggatgctgccaatatgctaaaaccggcattggcaagaggagaaatacaatgtatcggtgctaccactcttgatgaatatcgtaagaacattgagaaagatggcgctttggaacgtcgtttccaaaaagtaatagtagaaccgactaccgctgccgaaactttgcagattttgcgtaatatcaaggataaatatgaagatcaccacaatgtgtattatacggatgaagcattggaagcatgtgtcaagctgacagaccgctatatcacagatcgtaatttccctgataaagctattgacgctttagacgaagccggttcacgtgtacatcttaccaatgtcaatgtgcccaaagagatagaagaacaagaaaaactgatcgaagaagccaaaagcaagaaaaacgaagctgtgaaatcgcagaatttcgaacttgcagccagcttccgtgataaagaaaaagagctttctgtccaattggatgagatgaaaaaagaatgggaagccaatctgaaagaaaacaggcaaactgttgatgcagaagaaattgccaatgtcatctcaatgatgtcaggcattccggtacaacggatggcacaggctgaaggtatcaagctcgcaggtatgaaagaagatttgcagactaaagtcatcgcacaagatacagcaatagaaaaactggttaaagctattttgcgaagccgtgtagggctaaaagatcctaataagccaattggcacatttatgttcttaggcccgacaggagttggtaaaactcacttagcaaaagagttagccaaatatatgtttggttctgctgatgcactgattcgtatagatatgagtgaatatatggaaaagttcactgtttcacgcttggttggagcacctccgggatacgtaggatatgaagaaggtggtcagctgacagaaaaagtgcgccgtaaaccatactcgattgtattgcttgatgagatagaaaaagcacatccggatgtgttcaacatcttgcttcaggttatggatgaggggcgtctgactgacagttatggcagaatggtagattttaaaaatactgttattatcatgacttccaatataggaacccgtcagctgaaagaatttggacgtggcgttggctttgcgacacaaagccgcctggatgataaggaattctcgcgaagcgtaatacaaaaagctctaaacaaatcattcgcgcccgaattcatcaatcgtgtagatgagataatcacgtttgaccagctttctctggaagcaataacaaagattatagacatagagctgaaaggattgtatgatagaatagaatctattagttacaagcttgttattgaagataaggcgaaagaatttatcgccggcaaaggatatgacgtacaatatggcgcccgtcctttgaagcgagcaattcaaacttatctggaggatggcttatccgagctcatcatttcctcctctttgaaggagggagatactattcaggtatctctcaatgaagaaaaaggtgaattggagatgaaagttgtcactccggaataa

SEQ ID NO: 3178 - DNA, 4317 bp, Bacteroides xylanisolvens
atgagttcacgttttcctttatatataataggtatagtgttgtttacctcttttttttcgtgcactgatatggtgccgaccaaagaggtgcgcctgattgattctttaaacgggaaagcgtatacttatcgttatcgaagcctggattcttcttataagtatgccaatgaagcttatcaacaggtaaatttttataagtcggggaaagcggaggcatctaataatctcggattctgtgcttttatggcgatggattttgaccgggcggaagcgttacataaggaagtatataaactgactaaaaatgagcttgaactgttgattgctgatatcggactgatgaagatttgtcagcggacagctatgaacaaagaattttatgattatcgtaatagtgcgcttcggcgtatgaaacgtattcgggaagagagtgatttgtttgccgaccgccacgaggcacttcgactggattatgctttcaccgaatttttcattgtttcttctatttattactattatcttcagcaaaggcaggaagccatcgcatctctcaatcagatcccggaagatgaagtattggcagatacgaatcagttgctttattatcattatatcaaaggatcggcttcattggtggaagccaccaagccggaggacaggaaaatgcgtgagtttgaccaactatatataacctggaggactgcggttcagactaatcatccttatttcgaaggaaatggtctgcaagggctggctaatctgatggtttcttccaacaacttcgaactctttcgaacaaggaggggatacgcgctggatcagtttggttttcctgtagattcgcttttgcctttgcgaatggcacagcttgcgcttgaaaaattccgggagtataatgatttgtatcagattgccggtgcgtatgtgtctatcggtaagtatatgaatgagcacggacgttattcggaagcattggatacgcttacaaaagcgttagattgtgtgaaccaacaccatatgctttattatcatcatgcagtggatacgttggacaagctgcgtatttatgcggaaggagatacgacatatactggagtaccgtggattatggaggaagacgtaaggacggtgcccgaatggatttcgaggattcgggaacaattgagtgtatcgtatgccgggcttggaatgaagtatgcttctgattacaaccgaaatatatacctggatattctgaattatactcgtcaggataaagagttggagagtcgttatctttcgttggaatccgattcacgacaaatgacgcttgtactttctttggttattgccggacttgtactggtggttattctttggtggttcttcaataagcgatctaaaataaggaatcaagtagatgtggaacgtctgcaacggatactggctctttgccgggacatcacttcttctataccaatgaatgttccgttaattcaacaaggcattgaccagctgttcggaaaagggcgtcttcaactggaaattccggaggaaggaaaagcggcactggttcctttgcatcggttgaaccgtgatgaaaaagcgttggtgcacgtgctcgaaccgtatatcgtttgggctgcggacaatgagcagatggtagaagcgttgagtgacgaacggatgcaattggaaaagcaacgatatgtttacgaacaacatatcgcgggaaataaacgccagaatttgattaagaaggcttgtctggccattgtaaatgggataaatccttatatcgaccgtatcttgaatgaggtgcataagttgacggaacgaggatatatcgatcatgaaaagataaagaaagagaagtatcaatacattgacgagctcgtaactacgattaatgaatacaatgatattttggcgctttggattaagatgaagcaggggacgcttagcctgaatattgaaacgttcgatcttaatgaactctttgaactgttaggcaaagggagacgtgcttttgaaatgaaaaatcagaagttggaaatagaaccgaccacggttatggtgaaagctgaccgggcattgactttgtttatgattaacacgctggcggaaaacgcccgaaaatataccccggaaggaggaacaatcaaagtgtatgcccgtactacggatgcgtatgtcgagatttccgtagaagacaacggaagggggatttccgaagaagatatggctcgtattatcggtgagaaagtatatgattcccgtgtcatcggaatgaagaatgcagccgacccggaagttctgaaagaaaataagggcagtggtttcggactgatgaattgtaagggaatcattgagaaatataagaaaacgaatgaattgttccggggatgtgtctttgatgtagagagtgaattggggaaagggagtcgtttctatttccgtttgccttcgggagtgcgcaaaacgatgggagtcttgttgctttgcctgttgcttccgtttggggtgagttcttgtctgcatgatccgattcctcccatgttgcaggagggcgattcgatagtggtggttacggattctgcctatgaggatttgctggatgcagcgtcggattatgcgaatgccgcctattttgctaatgtggatgaaaattatgaatttgctttgcaatatatagattctgctatactcttgttgaacgagcattatgagaaatatgcgcgtccggatcgtccgcatcggtatatgaagctggtgggggaaggaacgcctgccgaaatcagttggtggaacgaattgtttgattcggattatcatgtgattctggatatcaggaatgaggcggcagttgcttttttggctttgaaacagttggatgcatacagttacaataattcggcatttacggatttgtataagttgcagggagaagatcagactcttgaagcgtattgccgacagttggaacggtcgaatacgaataagacagtaggaattattttatgttttgttctactgattgtttctttggtcggatactatttcctgtatatgagaaaacgtttgcagaatcgtttgaatctcgaacaggtacttgagattaatcaaaaggtatttgcagcatctttggtcagaccgcaggaacaagaaaatgcagaggcactccaacgggaggaaagtacgcttaaagaaatcccgcaacgtattgtggatgaagcattcggtccggtgaatgaactactgacaattgaccggatgggaattgccgtttataacgaaacgacacatcggctggaatacgcttctcgccccgggcaggaaatgccggagatggtagaacagtgttttagttccggagaatatctttctgaacagcatcttcaggcaattccgctgatggtggaagcaggaggtgaacatcaatgtgtcggtgtgctttatctggaacgcagagaaggaacggaacaggagacggatcgactgctttttgaactggtagctcgttatgtggctattgtcgtgtttaacgcagtggtgaagctggctacaaaataccgggatattgagtcggcacatgaagaaacacgtcgggcttcctgggaagatagcatgttgcatgttcagaatatggtacttgacaactgtctgtcgacgattaaacatgagacgatctattatccgaataaaatcaaacagattgtagggcggttgaatacgcagaagctttcggaaacggaggagcgtgaagcggtggagactatgacggaattgattgaatattataagggaatctttacgattttgagctcgtgtgcttcccgtcaattggaggaagtcactttccggcgtactgtgattccggtgcaggaacttttggacgctgccggaaaatacttcaagaaatcaatgaagaaccgttcggagaggatagaactggagatagaaccaatggaagcgaaagtgataggagacgtgaaccagttgcgttttctattggaaaatttgattgatgaagcattgactgtgcgtgaagatggattgatacgtctgcaagcacgtcaggataatgaatatattcgttttctctttacggatacgagacgtgaaaagagtgtggaagaattgaaccaattattttatccgaatctggcacgtatgacttccggtgagaaaggggagttgagaggaacggaatatctgatatgcaagcagattatccgcgaccatgacgaatttgcgggacgcagagggtgtcgtatcaatgctgagccggctgaaggcggaggatttacggtttatttcaccattccgcgccgataa

SEQ ID NO: 3179 - DNA, 1083 bp, Bacteroides xylanisolvens
atgaaacaggaatttacacgaatcgcagtaaaagtaggaagcaatgtattgacacgccgcgacggaacgctggacgttacccgtatgtcggcacttgttgaccagatagcggaattacataaatccggggtggaaatcattctgatttcttcaggagctgttgcttccgggcgcagtgaagtgcatccacagaaaaagctcgatagtgtagaccaacgccagttgttttctgccgtaggtcaggctaagctcatcaaccgttactacgaacttttccgcgagcatagtattcctgttggtcaggtgttgaccacgaaagaaagttttggtacccgccgccattatctgaatcagaaaaactgtatgacggtaatgcttgaaaataatgttattcctattgtcaacgagaatgatacaatttccgtcagcgagcttatgttcactgataatgatgaattgtccggactcatcgcttccatgatggatgcacaggctctcattatcctaagcaacatcgacggaatttacaatggttctcctgctgatccgggttcttttgttatccggaagatcgatcacggaaaagatttatccaattatattcaggcaactaagtccagtttcggacggggaggaatgttgacgaaaacaaatattgcccgcaaagtagctgatgaaggaattacagtgattattgccaacgggaaacgggataatattctggtagatttgcttcagcatccgaaagaaacgctttgtacacgttttatcccttcaaatgaaccggtatccagtgtcaaaaaatggattgctcatagcgaggggtttgccaaaggagaaattcacatcaacgaatgtgcgacagaagttctaaactctgaaaaggctgtcagcatcctccccatcggaattactcacgttgaaggtgaatttgagaaagatgacattgtgcgtatcatggactttcaaggaaatcaagtgggcgttggaaaggtgaactgcgattccaaacaggtgcaagaagcaatcggtaagcatggaaagaaaccggtagtacattatgactatctatacattgaataa

SEQ ID NO: 3180 - DNA, 2613 bp, Bacteroides xylanisolvens
gaaataagaaaggagaacaaagatatgaactttaacaattttaccattaaatctcaagaagcggtacaggaggccgtaaacctggtacaaagccggggacaacaagccattgaacctgtccacatcatgcagggagtaatgaaagtaggcgaaaacgtcactaatttcatcttccagaaacttggtatgaatggacagcaagtagctctcgtggtcgacaagcaaatcgactccctgccgaaagtatccggcggagaaccgtatctaagtcgtgaatccaacgaagttttgcagaaagcaacacagtattctaaagaaatgggcgatgagtttgtttcattagagcctatcatactggcattgctgactgttaagagtaccgtctccacgatcttgaaagatgccggtatgacggaaaaagaattgcgcaacgctatcagcgaattgagaaaaggagaaaaggttacatcacaatccagtgaagatacttatcaatcattggaaaagtatgctatcaacctgaacgaagctgcccgtagcggaaaactggatcccgtaatcggacgtgatgaagaaatccgccgggtattacagatattgagccgccgtacaaagaacaacccgattctgattggtgaaccgggtaccggtaaaacggctattgtagaaggtttggcacatcgtattcttcgcggagacgtgcccgaaaacctgaagaacaaacaagtttattcactggatatgggagcactggttgccggcgcaaagtacaaaggtgaatttgaagaacgattgaaatcagttgtcaatgaagtgaagaaatcagaaggtgatattattctgttcattgatgagattcacacgctggtaggtgccggaaaaggtgaaggtgccatggatgccgccaacattctaaagcccgccttagctcgtggagaactacgttccatcggagcaactaccctcgacgagtatcaaaaatacttcgaaaaggataaagcattggagcgtcgtttccaaatcgtgcaagtggacgaaccggataacttgagtaccatttccatccttcgcggattgaaagaacgttacgagaaccatcatcacgtacgtatcaaagacgacgcaatcattgcagccgtcgaattgagtagccgttacatcaccgaccgcttcctgccggataaagccattgacctgatggatgaagccgcagccaaactgcgtatggaagtagattccgttcctgaagaactggatgagatttcccgtaaaatcaagcagctggaaattgagcgtgaagctatcaaacgtgaaaacgataaaccgaaactggaaattatcggtaaggaacttgccgagctcaaagaacaggaaaagtcctttaaagctaaatggcaaagtgagaaaacgctgatggataaaatccagcagaacaaggttgagatagagaatcttaaatttgaagcagaaaaagccgaacgtgaaggcgattatggtaaagtagccgaaatccgttatggtaaacttcaggctttggataaagaaatagaagatactcaaaagcaactgcgtgatatgcaaggcgataaagccatgattaaggaggaggtagacgctgaagatattgctgatgttgtttcccgctggactggtattcctgtcagcaagatgctgcaaagtgaaaaagataaactgttgcacttggaagaagaacttcatcaacgtgtaattggtcaggacgaagcgattgaagcggtggcagatgctgtgcgccgtagccgtgccggattacaagatccgaaacgtccgatcgggtcatttatcttcctgggaaccaccggcgtaggtaagaccgaattagcaaaggcattggcagagttcctgtttgatgacgaaacgatgatgactcgtatcgatatgagtgagtatcaggaaaagcatagtgtctcccgtctggtcggagcgcctccgggatatgttggatacgatgagggcggtcagttgacagaagctatacgacggaaaccttactctgttgttttgtttgacgaaatagaaaaagctcatccggatgtcttcaatattctgttacaggtattagatgacggacgactgaccgacaataaaggaagggtggtcaacttcaaaaataccattatcatcatgacttcaaatatgggcagttcttatatacaaagtcagatggagaagttgcatggttccaataaggaagaagtaatcgaagaaacgaagaaggaagttatgaatatgttgaaaaagacaattcgtccggaattcctgaaccgtattgatgaaacgattatgttcttaccattgaacgaaaaagaaatcaagcaaatcgtacttttacaaattaaaggagtacagaaaatgcttgccgaaaacggagtggaactgcaattgacagaaggagcattgaacttcttatcgcaagtgggttatgatcctgaatttggagctcgtccggtgaagagggctattcaacgctatctgctgaatgatctatccaagaagttactatcacaggaagtcgaccgaagcaaagcaattatcgttgatgctgacggagacggattggtattcagaaattaa

SEQ ID NO: 3181 - DNA, 1698 bp, Bacteroides xylanisolvens
atggaatattctttttatgattttttaaagctcataggctcattaggactcttcctttacggaatgaagattatgagcgagggcttacaaaaggtcgcgggtgacagattgcgaagtattctaacggcaatgactaccaatcgggtaacgggagttttaacaggagtgttgataacagctcttatccagtcttcttcagcaacgacagtgatggtcgtaagtttcgtaaacgccggattgctcacacttgccgaatccatcagcgttattatgggtgctaatatcggtactaccgtgactgcctggatcatttcaattttcggatttaaggttgatatggctgccttcgctcttccgctcttagccatcgccctcccgctcatcttctccggcaaaagcaaccgcaagtccatcggtgaattcattttcggtttttctttccttttcatggggctttcttatctgaaagcaaacgcgcccgacctgaacgccaacccggaaatgcttgccttcgtacagaactacacggacatgggattcttctccatcattctgttcttactcatcggtactatattgacgatgattgtacaggcctccgccgccaccatggcaattacattgattatgtgcgccaacggatggatcagtctggaactgggagcagcacttgttttgggagaaaacatcggaaccactatcacggccaatcttgccgcacttacagccaatacacaggctaagcgggcagcattggctcattttgtttttaacgtgttcggcgttatctgggtcttgattgtcttccatcctttcatggaactggtaaactgggtagtagatacctttttccaaagtaacaatccggaagttgccatctcctacaagttatcggctttccactcgattttcaatatctgtaatgtatgtattctgatatgggcggttaaactgattgaacgtaccgtatgtgctcttatccaccccaaagaagaggacgaagagccccgtttgcggtttatcaccggtggtatgctttctaccgcagaactctctatccttcaggcacgcaaagaaatccatctttttgcagaacgtacacaccggatgttcggcatggtgcaggatttgctacacacagaaaaggatgacgatttcaacaagctgttcagccggatcgagaagtatgagaatatcagcgacaacatggaacttgaaatagccaactacctgaatcaagtatctgaaggtcggttaagctctgaaagtaaactacagatacgtgccatgttgcgtgaagtgacggaaattgaaagtatcggcgacagctgttataacctggcacgtaccatcaaccggaaacgtcagaccaaccaagattttaccgagaaacaatatgagcatattcatttcatgatgaaactgacgaacgatgcacttgctcaaatgattgtggtagtagaaaagccggaacatcagagcatcgatatcaacaagtccttcaacatcgagaatgaaattaataactaccgtaaccaactgaagaatcagaacattctggacgtaaacaacaaagaatatgattatcagatgggggtttattacatggatattattgccgaatgtgaaaagctaggtgactatgtggtgaatgtagtagaagctagtagtgatgtaaaagagaaaaaagcttcttga

SEQ ID NO: 3182 - DNA, 1977 bp, Bacteroides xylanisolvens
gtgaaaaggaaactaatatatatattctcgtgctggctgtcatccataatcttattcgtggcatgtgatgatatggaggacaaaccattcacatcaggcattataggcgatccgacagaaacgggtaccgccgaattatatgtattatgcgaaggactgttcaatcagaacaatagctcgctggcacgtttttctttcggcaaccagcaaatggttcgtgactatttcaaagcagtcaaccgccggggattaggagacacagccaatgacatggccatctacggaagcaagatatatgtgatagtcaatatctccagtacggtagaagtgatagactttcgtacgggaagctcattgaaacagattcagatgttggcagaaaacggaagttcccgtcaaccacgctacatcgcttttcacaaagaaaaggcatacgtatgttcatacgatggaaccgttgcacgtatagacacaacctccctatccatagaagctatcacatcagtgggacgcaaccccgacggtatttgtgtacaaaacgaaaagttgtatatttccaattccggcgggttggactattcatcaggactggtgggggtagacaacacggtatctgttgtcgatattgccacatttaaagaaagtagcaaactaacagtaggcccgaatcccggtaaaatagtagcagggccggacgaaaccgtttatgtagccacccgtggcgaagatgtagaagccggcgattataacttcgtcaagatagactgccggacaaacaaagtcactcaatctaacgagaaagtacaaaactttgccatcgatggagagattgcctatctatacaattacaattataacacgcagacctcttctatcaagatgttcaatctgaaaacagaagagacaatccgtgagaatttcataactgacggaacagtgataaaaacgccatacggcatcaacatcaatccttacagcaacaatgtatatatcaccgaagcccgtgattacaccacctatggagacttactttgtttcaaccaacaaggacaactcatgttccgtctgaacaacatcggacttaacccgaatacaattgcattcagtgacaaagcctcacaaagcgatattgatgacaacgatgatgataaggaaaatcctctggccttcgccaataaagtatgggaatatcgccctgctcccggacagtttatcaacactaccacttcagcatataagaaaggctttacttatgatgatatactagaagaagcaacccgcagaatccagcagaaatcactccttacattgggaggattcggcggttacattgttttaggattcccacaatccattccgaatgtaacaggagaatatgacttcaagataaaaggcaatgcttactataactccaaaaccggaacaggagcattgggcggaagtgcagaaccgggaatcgtatttgtatctaaagatgtaaatggcaatggaaagcctgacgacgagtggtatgaattgaaaggaagcgaatacgggaaagacactgaaacacgcggatacgagataacctatcaccgtccgaatccagccaacctaaaagttttttggaaagacaatcaaggcaacgaaggatatatcttccgcaacagcttccataaccaggaatcatattatccactttggatagaaagtgatgaaatcacattccagggaacacgtctaaaagataatgccgttttagagaacggattatgggtaggatattgctatccgtggggatatgcagacaaccatcctaacagcaaggaaggaagtaatttcaagatagattgggctgtggatagtaatggcagtccggtagacttggatcaaatcgacttcgtgaagattatgaccgcagtcaatcaggatgcaggacaaatgggtgaaatatcaaccgaagttaccaccattgagaacttacatttcaagaaataa

SEQ ID NO: 3183 - DNA, 1398 bp, Bacteroides xylanisolvens
ttattaaatacaaagaatgaagaagtttgtgaacttagatttgttgttacccttgtcctggcaatatttgctaatgtggcaacctatgcacaagataatgtggttgatgaagtagtttgggtagtaggtgacgaagctattttgaaatcagatgtagaagaggcccgtatggatgccttgtataatggacgcagatttgacggcgatccttattgtgtaattcctgaagagattgctgtgcagaagttgttcctgcatcaggcaaagttggacagtatcgaggtttccgaagcggaaatcatccagcgtgtggatatgatgaccaacatgtacatccagcagatcggttccagagagaagatggaggagtatttcaataaaacttccacccagattcgtgagacgctgcgtgataatgcacgtgacggattgaccgttcagaagatgcagcagaaactggtaggagaaatcaaagtgactccggcagaagtacgccgttattttaaagaccttccacaagatagtattccttacattccgacacaggtagaagtgcagatcattactttacaaccgaaaattcctatctcggagattgaggatgtaaaaaagacgttgcgtgattatacggatcgtgtgacaaaaggagaaattgacttctctacattggcgcgtttgtattcggaagacaaggcatctgccattaaaggtggtgaatgtggattcatgggacgtggtatgatggaccctgcttatgcgaatgtagcgttcagtttgcaagatccgaagaaagtttctaagattgtggagtcggaatttggtttccacattatccagttgattgaaaaacgtggtgaccgtgtcaacactcgccatatcttgttgcgtccgaaagtatcggaaaaagaactgaccgaggcttgtgcccgtctggattctattgctgatgatattcgtgccaacaaatttacatttgatgatgcggctgccgttatctcacaggataaagatactcgtaacaaccatggtattatggtgaacatcaatgaaaattcaggtgtgactacttctaagttccagatgcaggatcttcctcaagacgttgctaaagtagtggataagatgaatgtaggcgaaatttccaaagcctttacaatgattaatgagaaggatggaaaagaagtatgtgctatcgtgaagttgaaagcaaaaatcaacggtcataaagcaaccattgcagaagactatcaggacttgaaagaaattgtgatggacaaacgccgtgaagagatgttgcagaaatggattctggacaaacagaaacatacttatgtacgcatcaacgaaaactggcagaagtgtgacttcaagtatccgggttgggtcaagaaggactga

SEQ ID NO: 3184 - DNA, 1815 bp, Bacteroides xylanisolvens
atggaaaaactagaacagatcattaccacatatcagcaaatcattcagaaaacagaactggagttacagaatgcacggaaacgtatctattatataagtcttcttcgacttatcttattcgtaggagccgtagcaaatgccattattttttggtctgacggttggctatgcctctctgcattcgctgtcctaccctttatcttattcatttggttagtaaaacgccataatttctggttctaccggaaagactttctgaaaaagaaaatagaaatcaacgagcaggaactacgtgccatgcaatatgatttttccgattttgacgatggaaaagaattcattaacccgtctcacctctacactcttgatctggacgtatttggagaacactctctcttccaatacatcaaccgcaccgcaacccctatcggcaagcaacatctcgcaaactggttcaatgcacatctggagaataaagcagctattgaccaccgccaggaagccatccgggaactctccaccgatttggaatatcgccaacaaatccgcttactcggattactctataaaggaaaacctgccgataccaccgaaatcaaagaatgggcagccagtccgagttattatcgaaaacgtacgctcctgcgtatcctcccaatagcggttaccgtcattaatttcttatgtataagtctagccattttaggcattatctcggctaacattgcaggaggagtatttgtcagctttgtattattcagtactattttctctaaaggaatcactaaactgcaaacaacctacggagaaaagctgcagattctttcaacatacgctgaccaaattctgctcactgaacaaaaagaaatgcacagtcatatactgcaagagttaaaaacggaccttacaagtcaaaatcaaaccgcttctcaagcagtccgccagctttctaaactgatgaacgcactcgaccaacgaagcaatctgctcatgagtactatactcaacggactgatattttgggagctacgacaggtgatgcgaatcgagaagtggaaagagattcatgcctccgacctcccccgatggatagaaacaatcggagaaatagatgcctattgttccctggcaacattcgcatataatcatccggattatatttaccccactatcgctgctcaatctttccacctacaagctgaagccttggggcatcccctaatggatcgcaaccaatgtgtgcgtaacggaatagacattgaaaaacgtcctttctttattataatcacaggcgccaatatggcaggcaagagtacttatttacgtactgtaggagtaaactatctactggcatgtataggagctcccgtttgggcaaagcaaatgaaaatatatccggcccgtctcgttaccagccttcgaaccagtgattccctagctgacaacgaatcttatttctttgcagaactcaagcgacttaaattaatcatagacaaacttgaagccggggaagagcttttcatcatccttgatgaaatactgaaaggcaccaactccatggacaaacagaaaggctctttcgcccttatcaaacaattcatgcacatgaacgccaacggtatcatcgccacccatgacttgttattagggactttaatagagtccttcccacaaaatatccgaaattactgtttcgaagccgacattaccaacaatgaactcaccttctcatatcaaatgagaaacggagttgctcaaaacatgaacgcctgcttcttaatgaaaaaaatggggatcgccgtcattaacgactaa

SEQ ID NO: 3185 - DNA, 1464 bp, Bacteroides xylanisolvens
aaattaataaaaatgggtagaaagaactcaccatcagccaaaaagcaactagccacacttatcacaaactacgaagaagcaaaagcagaaaaccgacaactttatctggatgctgaccaactggccgacatcgccgactggtatgcctccgaacggaaatttgaagaagcacaagaagtaatcacctacggacttaagatacatccgggaaatacagctttactcatcgaacaagcctatctttacctggacacccaaaaactgcaaaaagcaaagaaagtagcagattccatcaccgaagattttgactcggaagtgaaactgctgaaagccgaactattgctgaatggaggaaaactggaagaagcccaatggctattaagtacgatagcggatgccgacgaactggaaacaatcattgatgtcgtatttctctatctggacatgggatacccggacgcagccaaagaatggctcgaccgaggtaaatcgcgttatgccgaagatgaagaatatatggccctcacagccgattatctggcatcgacccaccaagtagaatcggctatcatctattacaacaaactcatcgacaaatcccctttcaacccttcctattggatgggactggtgaaatgttactttgttcaggaacaaatagacaaggccatcgaagcctgtgattttgcgttggcagccgacgatcagtgtggagaagcctacgcttataaagcgcattgttttttctatctgaacaattcggatgatgccatcgagaattaccaaaaagcgatcgaacttaaatccatcccccctgaactgggttatatgttcatgggaatatcttacggcaataaagaagaatggcagaaagccgatgactattacgacaaagtaatcgcacgttttgaagaagacggagacagacagtctgtcctattaatagacacatataccagcaaagccttcgccctgtctcatctggaaagatatgaagaagcacatcagctctgcgagaaagccaaagagataaacccgaatgaaggattgatttatctgacagagggaaaactatatctggcagaggagctggaagacgaagcagccttgtctttcgaaaaagcgatagagattaactctaacatagaaatgtggtatatgatcgcctctgcttattcggaaagtgactatctgatagaagccaaagaatactttgaaaaagcgtaccagatgaatccgaaatacgaagatgtgacggagaaattgagtgtgctttgcctcatgcacggtgaaatcgacaacttctttaaatacaacaaagaatgtgaacatccactggaagaagatatgattctggatctgttaaatagtcccgaacatagagaggaagatgaaagaactctcaaggaagtgtgggaacgcatgaaaaaagagaataagaaaaagaagaaagggaaaaaataa

SEQ ID NO: 3186 - DNA, 3180 bp, Bacteroides xylanisolvens
atgagaaaaaatgctagatttaaaatatttagttatttttgcggtgtgatgaacaaacagtatcttattatatcattgaaaaaagaaattttagtaagttgtttcttaatgagcctatttttcctggagggtgggaattgttatgcttcggagcaacaactgttaagagggacgatagaaactccttctgacaattataccgtgagagggcgtgttatggatgtctatggtgaaccactaatcggtgctacaatacgagagaaagggggagccaatggtactgtgaccgatattgatggacgattctttttatctgttccggatagtgctgtcttgcaggtttcttttgtaggttacaaaactttagaagtcaatgtgacaggtcggactatgcttgaaatacgccttcaggaagacgcggtgatgcttgatcatgtcatcgcaacagccttgggaattgaaaaggatgaagctacactggcttattctgcgcagaaaatcaaaggtgaggaactaaatcgtataaaagaaataaatatgattactgccctggcgggaaaagctgccggtgtacaaatcaataaaaactcttccggtatgggagggtctgccaaagtcagtctccggggaatccgttcggtgtccggtgataatcaaccgctgtatgtgatagacggagtgccgatgtcgaatacctcttccgagcaggcttattcggcaattggaggtacggcgaatgccggcaaccgtgatggaggagatgggatttctaacctgaacccggaagatgtggaaagcatcagtatcttgaaaggtgctccagcagcagctttatatggtagcatggctgctaacggggtcattcttatcactactaaaaaaggaaattctgtcgggcaaaggaatattaatttctctacgggactaactttcgagaaagcattcagcctgcctaaaatgcaggatcgttacggtgtcagtgatgtggtagacagctggggtgagaaagataatctgacggctcatgataacctgaatgattttttccgtaccggattgacctcaatgacttctgtgtccgtcagctatggaaatgaaactctacaaacttatttctcctatgccaacaccaccggaaaggggattatggataaaaacaagctgaagaaacataatataaacctacgcgaaacagctaccatgttcaacaaacgtctgaaactggatggtaatgtgaatgtaatgaaacagactgttgagaataagccggtatcgggaggcttttatatgaatccgttggtagggctttatcgttttcctcgtggtgagaatctgtcttattataaagaccattttgaaacctatgacgaagaacggaatttgaatgtgcaaaactggcatacatttaccgaagacttcgaacagaatccatattggatagtgaaccgtatacaaagtaaagaaacgcgtacgcgcattatcctttccctttcggcaaactttaaaataaatgattggttgactattcaagctcgtggcaacatggattattgggctgataagttgcgtcagaaattctatgcatctaccgctactgccctgtgtggagcgaacggtcgatatattgaaatggattatcaggaaacgcagatgtatggtgatgtcatggcgatgtttaagaaaacctggggagattttacactggatgcggctattggcggtagtataaatgaccgaatcagaaactcgacccgttatgattccaagaatgcttctttgaagtttgctaatgtttttaatattgccaatatcatcatgaacagttctgccagtattgaccagaaaatagatgagcatcgtcagcttcaatctattttcggtacagcacagattggctacaaggaaaaattatttcttgatttgacagctcgtaatgactgggcatcaaccttggcttatactgaacatgagaaagcgggatttgcttatccttccgttggtctttccatattgcttgataaatgggtgaagctgcccgaatggatttcttttgcgaaactgcgtggtgcctatagtaaagtggggaacgatattcctgtatttgtcactaattccacttctcatatcggtgccggtggcgagatacaggcaaatgatgcagctcctttcaaagatatggagccggaaatgactcatgccatggaattcggaacggaatggagattcttccaacatcggttaggaatcaatctgacctattatcgtaccaacacttataatcagttcttcaaacttcctgctcttgcaggtgataagtatgcttaccggtatgtgaatgccggaaatatccaaaaccaaggatgggaagtgacactgaacggaactccaatactaacttctgatttcacctggaaaacttccatcaatttttctgctaacaagaataagatcgtgaagctgcacgacgaattgaaagaattagtctacgggcctacgagcttttcttccagttatgcaatgaaactggtgaaaggtggttctatcggtgatatctacggtaaagcctttgtacgtgatgccgcaggaaacattgtttatgaaacagaaggagattacaaaggacttccattggtggaaggtgacggaaatacggtgaaagtaggaaatgccaaccctgtctttatgatgggatgggatcacacattctcttacaaaggattcagcctttatttcctgcttgactggcgttacggaggaaaagtcctttcgcagacacaagcggaaatggatctctatggcgtatcggaaattacagctgatgcacgcgacagaggatatgtgatgcttgaaggtcagcagatcgataatgtgaaaggattctataaaaatgtagtgggtgggcgtgccggagtgacagagtattatatgtatgatgccactaatttacggttgcgcgaagtatcgttgagctacaatttctcaaagaagtggatacagaaaacgaaggttctgaaagatgtgcagctttcgtttgtggcccgcaatctatgtttcttatataagaaagctccttttgatccggatttggtactttccaccgggaatgataaccaagggattgaagtattcggaatgcctacaacccgtagtttgggctttactctgaaatgtgaattttaa

SEQ ID NO: 3187 - DNA, 756 bp, Bacteroides xylanisolvens
attatgaaagaaaacaaatacgacaatagcgatttcttcagtcaatattctcaaatgtcccgctcggtggaaggcttgaaaggagccggagaatggcatgtattgcagaaaatgctccccgattttgcagggaaaagagttttagacttaggctgcggattcggttggcattgtgtctatgcgatagaacacggagcaacacacgttaccggaattgatatttcggagaaaatgctcgaagaagcccagaaaaggaatccttctccactcattgaataccaatgcatggctatcgaagactttgatttccagccggatacttatgatattgtcatcagttcgctaaccttccattatctcgaatcttttacggatatatgcaggaaaatcaataactgcctaactccgggaggcgccttcgtcttctccgtagaacatccggtatttacagcctatggcaatcaggaatggcattacgaccaagacgggaagcctatccattggccggtagatcgctattttacggaaggcaggcgcacagcaatctttctgggcgaagaggttgtcaaataccacaaaacgctgactacgtatataaacggactccttcaaaccggatttgagatatgcgaacttatagagccacaaccggacgaaagattgctggataccatcccgggcatgaaagatgaattacggcgtccgatgatgcttttgatctctgccaagaaaaaaagtaaagacgcaaagctatga

SEQ ID NO: 3188 - DNA, 1173 bp, Bacteroides xylanisolvens
ttgaaaacaaattttaatcacgtgatggatctgacagagtttaatgaaattcgtccttacaatgatgaggaacttcctcaaatctttgaggaactgattgccgatccggcttttcagaaagctgctaccggggctataccgaacgttccatttgaacttctggcgcagaaaatgcgtgcctgtaagactaaacttgattttcaggaggcattttgctatggtattttgtggaagatagcggcagatcataccgccgggctgacactggatcataccgccataccggataaaagtaaagcttatacgtatatatcgaatcatagagacattattctcgattcgggctttctctctattttgttgattgaccaggggatggatacggtagaaatagcgattggagataatttgctgatttatccctggattaagaaactggtacgtgtcaataaatcattcattgtacagcgggcattgacaatgcggcagatgttggaatcttcagcacgtatgtcccgttatatgcattacaccatttcggagaaaaaacagtctatttggattgcgcagcgtgaaggacgtgcaaaagattcgaatgaccgtacacaagacagtgtgttgaaaatgctggcaatgggtggtgaaggtgatttgatagaccgtttgatggaaatgaatattgctccgcttgctatttcatacgaatatgacccgtgtgattttctgaaagcgcaggagtttcagttgaagagagacatcgaagggtataagaagacgacgcaggacgatttgattaatatgcaaaccggtcttttcggatataaaggcagggtacattttcaggttgccccttgtctaaatgatggtctgaaagagttggaccgttcgttgccgaaaccggatttgtttgcccgtatctctgcctgtattgaccgccgcattcatcgtaattaccggatatatccgggaaattatgtggcgtacgattggctgaatggcacgacggaattcgggtccaattacacggaagaagagaaacaacagtttatgaactatattgaacaacaattggcaaagatcaagattccgaataaggatgaagactttttgcgtgagaagttgttattaatgtattccaatccgttagttaattatttagcagcttgccgatga

SEQ ID NO: 3189 - DNA, 2208 bp, Bacteroides xylanisolvens
ggggggaagggaggtcgttcaaacttaaaatgcttattatataatttaaaaattgatagattgcttatgaaacaaaagaaaatgcttacacttactttttcacagttgaaacaaatctatggtcaggagactccggagatagtggagatagcggataagagctctactgttgaggatttcaaggctggaatactgcggttgctggagacttgcaggatagaaaacgaagctgcggaggaggcgagggagcaaattcgactcttacttgattatgatgggcaaaatgttcatgaactgtctacgggacaggatatgtcagtacagactattcggctgctttatgagtttctgacggggacgttggagaatatggagatgccgacggatttgtttattgaaatttttcatatgtttaaacggttgaagggagaagttatgcctttgccgtcaccgcagcgtatcaaaagtcggaatgaccggtgggaaaccggactggatgaagaggtacgggagatacgggatgaaaataaggagcggatgttgcacttgctgattcagaagattgagaacaggaagtcgaagccttcggtgcgtttccactttgaggaaggaatgagttatgaggagaaatacaggttggtgagtgagtggtggaatgatttccgctttcatttggcgatggctgtgaagagtccgggagaactgaatcggttcctggggaattctctttcttcggagacgatgtatttgctttatcgggcacgaaagaaggggatgccgttttttgcgactccttattatttgtcgttactcaatattaccggatatgggtataatgatgaggctatccggagttatattctgtattcgccacggttggtggagacgtatggaaatattcgcgcgtgggaaaaggaggatattgtagaggttggtaaacctaatgctgcgggatggcttctgccggacggacataatattcatcgccggtatccggaggtggctattctcattcctgacacgatgggaagggcttgcgggggactttgtgcttcttgccagcggatgtatgatttccaaagcgaacggttgaatttcgagtttgagtctttacgcccgaaggagtcatgggatcgtaagttgcgccggttgatgacttattttgaagaggatacacagctgcgggatattctgattacagggggcgatgcgctgatgagtcagaataagacgcttcaacatattttggatgcggtgtatcggatggcggtacgcaagcagaaggcaaatctcgaacgaccggaaggagagaaatatgcggaattacaacgggtacggctggggtcacggttgttggcttatttgccgatgcgtatcaatgacggattggtggatattctgcgggaattcaaagaaaaggcttcggctatcggggtgaaacagtttattatccagactcattttcaaacaccgctggaggtcacgcctgaagctaaagaggcgattcggaagattctttctgccggatggattatcacgaatcagttggtatatacagtggctgcttcgcgtcggggacatacgacacggcttcgccaggtgctcaattcattgggcgtggtatgttattatactttctcggtgaagggattcaatgagaattatgcagtatttgctcccaacagccgttcgatgcaggaacaacaggaggaaaagatttatggtcggatgacactggaacaggcggaggaattatacaaaatattagagacgaaagtcggaacggaagaggagacgaaagaagatgttgccaagcaattaagacatttcatgagaaaacatcatttgcctttccttgctacggatcgcagtgtattgaatttgccggctatcggtaagagtatgaccttccaattggtgggactgacggaagaaggaaaacggattctacgcttcgaacatgacggcactcgtcatcatagcccgattatcgaccagatgggacagatttatattgtagaaaataaatcactggccgcttatctgcgccaattagccaagatgggagaagatccggaagattatgcttctatctggaattatacgaaaggagaaaccgaacctcgcttcagtctttacgagtatcctgatttccccttccgcactactgataaaatgagtaatttagaaataagtaataagtactaa

SEQ ID NO: 3190 - DNA, 2466 bp, Bacteroides xylanisolvens
atgaaagaaagatatttattggaagatggaagcgataacggcttctcgctaatcactgactatgatgggaacgatgaacaggcatttgatgtaaatgtgaaatctggtgaaattcttccggtactccctctacgtaacatggtgttgtttcctggagtattcctgccgatcacagtgggccgtaagtcttctctgaaactcatacgagacgctgacaagaagcataaagatattgccgtagtatgtcagagatcggcacatacagaggacccgaagttggaagatttacacaatatcggtaccgtaggacgaattgtgcggatattggaaatgcccgatcagacaacgactgtcatccttcaaggaatgaaacgtctgaacctgataaacattatcgaaacccatccgtatctgaaaggtgaaatagaacttttggaagaagacattccaagcaaagacgataaagagtttcaagccttggtggaaacctgcaaggacttgacaatgagatatatcaaatcgtcagatgtgatgcatcaggattcggcatttgctattaagaatatcaacagtccgatgttcctagtcaatttcatctgctcgaacctgccgttcaagaaagacgagaagatggacttgttaagcatccactcattacgtgaacgcacatatcacttactggaaatcctgaaccgcgaagtgcaactggcagaaatcaaggcatccatccaaatgcgtgcccgcgaagatatcgaccagcagcaacgcgaatacttcctgcaacagcaaatcaagactatccaagatgaactaggtggcggcggccaggagcaggaaatagaagaaatgcgccaaaaagcagaaagaatgcgttggaacgcagaagtcagggaaacatttatgaaagaactggctaaactggaacgcacccatccacaatctccggattacagcgtacagcttaactatctgcaaaccatgctcaatcttccgtggggtacgtatacaactgacaatctgaaccttaaaaacgcagaaaagacgttgaacaaagaccattacggactggaaaaagtgaaagaacgcattttggagcatttggctgtattaaagctgaaaggtgatatgaaatcaccgattatctgcttatatggccctccgggagtaggtaaaacatctcttggaaaatccattgcatctgcgctcaaacggaagtatgtacgtatgtctttgggcggcgtacatgacgaagctgaaatccgcggacatcggaaaacttatatcggcgccatgcccggacgaatcatcaagagcttgattaaagccggtgcatccaatcctgtctttatcctggatgaaatagacaaggtcagcgccgaccgtcaaggcgacccctcttccgcattactggaagtgcttgatccggaacaaaatactgctttccacgataacttcctggatgtagactacgacctctcaaaggtattgtttatagcaacagccaacaacctgaacacaatccccggcccattgctcgaccgtatggaattgattgaggtaagcggatatatcacggaagagaaagtagagatagcccgtaagcatctgcttcccaaagagctggaagccaacggacttaaaaagacagctatcaagcttcccaaagaaacgttggaagctatcatcgagtcatatacccgtgagagcggcgttcgtgagctggaaaagaagattggtaaaatccttcgtaaatcagcccgtcaatatgctacggacggttatttcgccaagacagaaatcaaaccgtcggatttgtatgacttcctgggagcaccggaatatacacgtgacaagtatcagggaaatgattacgcaggcgtagtcaccggattggcatggacagccgtcggaggcgaaatcttatttgtagaaacgagcttgagccgtggcaagggcggacgtctcacactgaccggtaacctgggagatgtgatgaaagaatctgccatgctggcacttgaatatatcaaggcacacgcttctatcttgaatctggacgaagagatcttcgacaactggaatatccatatccacgttcccgaaggcgcaattccgaaagacggtccgtcggcaggtattacgatggccacctccctggcttctgccctgactcaaagaaaagtgaaagccaacattgccatgacgggcgaaattacccttcgcggcaaagtgcttcccgtgggtggcatcaaagagaagatattggcagccaagcgtgccggaatcaaggaaatcatcatgagtgccgagaacaaaaagaacatagatgagattcaggagatttatctgaaaggactgactttccactatgtaaacgatataaaagaggtatttgccattgcgctgaccaatgagaaagtgtcggatgctattgatttatccgttaagaaacccagccaggaatga

SEQ ID NO: 3191 - DNA, 1539 bp, Bacteroides xylanisolvens
cgaaaaatggaattacccgcttctttcatagattatacccgtgccctgttgggcgatgaagaatacgacaaattagctgttgctatccaacaagaaccacctgtcagcatccggttgaatgatgggaaattaaaaattgaaaatggaaaatgcagaattgtaccgcaagcaggctgtattactgattttcaactttcagctttcaattttgaatttaatcaagtcccttggtcttccgaaggattttacttggatgagcgtctcactttcacgtttgatccattgtttcatgcaggttgttattatgttcaggaggcttcttctatgtttgtggagcaggtgctccggcagtatgtcaccggaccggtaaagatgctggatctttgtgcagctcccggtggaaagtctactcatgcccgtagtgtgcttcctgaagggagtttactggtggctaatgaagtcatccggaatcgttcgcagattcttgcggagaatttaacgaagtggggacatccggatgtggtagtaaccaataatgatccggcagattttgcggctttgccgtctttctttgacgtgattcttacagatgtcccttgctccggtgaaggtatgttccgtaaagaccctgttgctgtagaagagtggagttccgagaatgtagaaatctgttggcagcggcagcggcggattattggagatatttgggacacgttgaagcctgggggagttcttatatatagtacgtgtacatttaatacaaaagaggacgaagagaatgcacgttggattcaacaagagtatggagccgaaccgttaactgtgcaggtacaggaaaactggaatataacaggagatcttttaccggataattgtgatggttctaaatcttctattcctgtctatcattttttccctcataagacgaaaggcgaaggctttttcctggcagcttttcggaagccggagacaggagacgagattccgatatcttctttcgccaaggagaagacttctaaaaagaaagataagaaaggaggagcagcatcttctcctgtttcgaaagaacagttgaatattgcaaaaagctggctgaatgatgaaaattcggacaagtatatattgtcggcagaaggaacaagtatccgagctttttcaaagcattatgctgatgaattaatagcgatgaaacaatgcctgaaaattgtatcggcaggagtggagataggagaagtgaaaggaaaggatttgatacctgaccatgcattggcgatgtgtagttcacttttatgtcgggaagctttcgctacggaagaaataagttataaacaggctatcacttatttacgaaaagaggccattaccttgccggtaacagcccctcgtggatatgttttgcttacgtaccagcatattcctctcggatttgtgaagaatatcggcaatcgtgccaataatctctatccgcaagaatggcgtatccgtagtggatacttgccggaaaatatacgcatattatcggaaaatacggctgattaa

SEQ ID NO: 3192 - DNA, 1080 bp, Bacteroides xylanisolvens
aaaaagagtatgagatacacacttgaaatacaaaaactgctgttgcagacacagaatgacagcctgcatccccgtgaaaaagctaatctattgaaagaagctatccgcatcgctgatgagaacgaagatgtggaatgggctacggagttgagactggatcttatctatgaactgaatcttctttcggcagatgcagaagagattaccgtgttctctaaaatcctggatgattacgagaatcacaaggatgtaatcaaagaagatgacttgttgtggaaatataaatggatctgggcttgtacgttcgatctgccggaaattccgatggaacaggtgaaagcgatcggagaggattataaaacccgtattctccggaatggatattctttgcggagttattatcaccgctggtctgtggaatgtgtttggatgcgccagtatgacaaggcaaaagaatacattgacaagatgctgaatgaaaagatagacggtcagtcgtgtgaggcttgcgaactgaattttatgctggattattatttggaaacagggcagtttgatgaggcttacagccgggcgcagccattgattaataagcaggtcacctgttatgaagccaatttgcgggcttacttgaagctctcctattatgcacagaaagctgacaaaccggaggttgccgctgatatgtgtgcacgtgccgaagaagcattgcagggaagagaaaaggatgaatatcttttgctctacttgggattgtttattgcttataatataatgacgaagccggaaagaggctgggagtatgccgagcggtgcatcggttggagtttgcgtacgaatacgttgaagaaatatcgcttctcttgcgatatggtagaggccttgaagtatgagacccgtccggaagtctccttgtcgttgccggaggaattccctctttatcgtccggatggaatttatcaggtcagcgagcttcgcaattatttctatcagcaagcagaagagctggcacttcgctatgatgcccgcaacggaaatagtggttatatggaccgtttgaaacaattaatgtccaattaa

SEQ ID NO: 3193 - DNA, 1674 bp, Bacteroides xylanisolvens
atgaaacagatgttacaaatatgttgcaaaaataacaatatttctaaagaattccctatcggaagctcacttttggatatttattacggttttaatcttaattttccttatcaagtagtaagtgccaaggtcaataatcgctccgagggactgaacttcagagtttataataataaggatgtagagtttttggatgtgagagatcagtccggtatgcgtacgtatgtccgttcgctttgttttgtcttgtttaaggctgtcacggaactgtttcccgacggaaaattgtttgtagaacatcctgtttcaaaaggctatttctgcaatttacggattggccgtcccatcgaactggaagatgtgacacgcatcaagcaacggatgcaggagattatcgcggagaatatttcctatcatcgcatcgaatgtcatacggctgaagctgtgcgtgttttcagcgaacggggaatgaatgataaagtgagattactggaaacttccggttcgctctatacctattattatacattgggtgataccattgattattattatgggaatctgctacccagtaccggatatcttaaattattcgatatcgtgaaatattacgatggattgctccttcggattccgagtcgggaaaacccgaatgtgcttgaagatgtagtgaagcaggaaaaaatgctggatgtctttaaagaatatctgaactggagttatatcatggggcttaacaatgccggggattttaatctggcctgtgaagagggacatgcaaccgatctgataaatgttgcagaagcactgcaggagaagaaaatagcccagatagccgataccatattccatcgtggtgaaaacggtaaccgggtaaaactggtattgattgccggaccatcctcttcgggaaagacaactttcagcaaacggctttctatccagctaatgaccaatggactgaaaccattcccgatctctttagataattactttgtggatcgtgaagagactcctctggatgaaaacggaaattatgattatgaatcactgtatgcacttgatttggaactgttcaatcaacagttgcaggcactccttcgcggtgaagaggtcgaactgcctcgttttaatttctctcttggcaagaaggagtataaaggcgataaactgaaaatagaagataatacgattctgattctggaaggtattcatgccctgaacccggaactgacaccgcatataccggctgaacggaaattcaagatttatgtttcggcattgaccaccatctctttggatgaccataactggattccgacaactgataaccgtctgttgcggcgtattatccgtgacttcaattatcggggatattcggctcgtgaaacgatatcacgctggccgagtgtacgtgccggtgaagataaatggatttttccctatcaggagaatgccgacgtaatgtttaattcagcgttgctttttgagtttgcagtactccgtttgcatgccgaacctattctgatgggtgtcccgcgcaactgtcctgaatattgcgaagcataccgattacttaagtttatcaaatattttgttcctgtacaggataaggagattccgcctacgtccttactgcgcgaatttttgggaggtagtagctttaaatattaa

SEQ ID NO: 3194 - DNA, 2004 bp, Bacteroides xylanisolvens
tgtatttttgccttaaacaatcgaagaaatatggatataaaggaaaaaatagaggaattgcgtgccgaacttcaccggcataattataattattatgtgttgaatgctcctgaaatctcggataaagagtttgacgacaagatgcgtgaacttcaggatttggaacaggcacatccggaatataaagatgaaaattcgcctacgatgcgtgtaggtagcgatttaaacaagaatttcacgcaagtggctcataaatatcctatgttgtcactggcaaatacatattcggaagcggaagtgatggacttctacgaccgtgtccgtaaggcattgaatgaagatttcgagatttgttgtgaaatgaaatatgacggtacttctatttcgctgacttatgaagatggaaagttggttcgtgccgtcacccgtggggatggagaaaagggggatgatgtgacggataatgtgaaaacgatccgttctattccgcttgtattgcatggtgataattatcctgcctcttttgagatacgtggagaaattcttatgccatgggaagtgtttgaagagttgaatcgggagaaagaagcgcgtgaagagccgctttttgccaatccgagaaatgcggcttccggcacattgaagttgcagaattcttctattgtggcttcccgcaaactggatgcctatttgtattatttgctgggtgataacctgccttgtgacggacattatgaaaatcttcaggaagcggcaaaatggggctttaaaatctctgatttgacgcgtaagtgccagacattagaggaggtttttgaatttatcaattattgggatgtagagcgtaaaaatctgccggttgccacagatgggattgttttaaaggtgaacagtttgaggcagcagaagaatttgggatttacggctaaatctcctcgatgggctattgcttataaatttcaggcagaacgtgcgttgacccgtttgaataaggtgacttatcaggtaggaagaaccggagctgttacaccagtagctaatctggatcctgtgcagctttcagggacggttgtaaaacgtgcgtccttgcataatgcggatattatcgaggggcttgatttgcatattggagacatggtttatgtagaaaaaggcggtgaaattattcctaagattacaggggttgataaagatgcacgtagttttatgcttggtgagaaggttcggttcatcgttaattgtcccgaatgtggcagtaaactagtcagatatgaaggagaagctgctcattattgcccgaatgaaacagcgtgtcctcctcaaatcaaaggcaaaatagagcattttattagtcgaaaggctatgaatattgatggattagggccggaaacggtggatatgttctatcgtttgggattaattgaaaatacggccgacttgtataaacttacagttgatgatataaaaggtttggatcgtatgggtgaaaaatcggcagagaatatcgtaacgggaattgcgcaaagtaaaacagttcctttcgagcgtgtaatctttgctttaggaatccgctttgttggtgagactgtggctaaaaagattgcgaagtcgtttgagaatatcgatgatttacagcaggcagatcttgaaaaattggtaagtatcgatgaaatcggagaaaaaatagctcaaagtatacttgcttattttgctaatgagtctaatcgtgagttggttaacaggctaaaggaggctggattgcaactttatcgcacagaggaagatttgagtggatacactgataagttggcagggcagtctattgttatcagcggtgtgtttatccatcactcgcgtgacgaatataaggaacttatcgagaaaaacggaggaaaaaatattggaagcatttccgcgaaaacgagttttatactggctggagataatatgggacctgcaaagctcgaaaaagcaaaaaaacttggaataaccatattaagcgaa

SEQ ID NO: 3195 - DNA, 1440 bp, Bacteroides xylanisolvens
atgaaagcattaaacaaagaaactgctcctaaaacacaacgtccggagcgtattatccaatttggcgaaggtaacttcttgcgtgcatttgttgattggattatttacaacatgaaccagaaaaccgacttcaacagcagcgtagtagtggttcaacccattgataaaggtatggtcgatatgctgaatgcacaagacgatctttatcatgttaatcttcaaggattggataaaggcgaagttgttaacagcttgacaatgatcgatgtaatcagtcgtgcactgaatccatattctcaaaatgacgagttcatgaaattggcagagcaacctgaaatgcgttttgttatttcaaacactacagaggctggtatcgcttttgatccgtcttgcaaacttgaagatgctcctgcttcatcttatccgggtaaactgactcaattgctgtatcatcgtttcaaaacattcaatggtgataagacaaaaggtttgattattttcccttgcgaacttattttcctgaatggacataagttgaaagaaactatttatcaatatattgaattatggaacctgggtaatgagtttaaaacttggtttgaagaagcttgtggcgtatatgcgacattggtagaccgtattgttccgggattcccgcgcaaagatattgctgctatcaaagaaaaactgcaatacgatgataacttggttgttcaggctgaaatcttccatctgtgggtgattgaagctccgcaggaagttgccaaagagttcccggctgataaggcaggactgaatgtgttgtttgttccttcggaagctccttaccacgaacgtaaggtaactctgttgaatggtccgcacacagttctttctccggttgcttatctttctggtgtgaatattgtgcgtgaagcttgtgaacatgaggttattggtaaatatatccacaaagtaatgttcgatgagttgatggaaacattgaatttaccgaaagatgagttggagaaatttgccaatgatgtattggaacgtttcaacaatccattcgtagatcatgcagtgacaagcattatgctgaattctttcccaaaatatgaaactcgtgatttaccgggattgaagacttatctcgaacgtaagggcgaacttcctaaaggcctggtacttggtttggctgctatcattacttattataaaggtggtgtacgtgctgacggcgctgaaattgtaccaaatgatgctcctgaaatcatgaacctgctgaaagaactttgggcaactggttgtacaaagaaagtaaccgaaggtgttctggctgctgactttatctggggagaagatttgaataagatcccgggattggcagaagctgtaaaagcaaacttggattctatccaggaaaagggaatgcttgaaactgtgaaaggtattctgtaa

SEQ ID NO: 3196 - DNA, 2121 bp, Bacteroides xylanisolvens
tttattcacatgaaaaaagtaactttattaatgagtggaatcatggtgatgtcatgcgctccccaacaaaaaaagctggtctaccccgagacggcaaaggtagacactgtagatgtgtacttcggcacacaagttcccgacccttacagatggttggaaaatgacaccagtgcagccactactgcctgggtagaagcacaaaacaaagtaacgaatgagtatcttagccagattccgttccgcgaaaacctgctgaaacgattgacgacactggccgattacgagaagatcagtgctccgatcaagaaacatggaaagtattatttcagtaaaaatgacggtctgcagaaccagagtgtattctatgtgcaggactcattggacggcgaaccgcgtgttttcctcgatccgaacaaactatcggacgacggaacagtagcactgaccggtctttatttctcaaacgacggcaagtacaccgcttacagtatttcacgcagcggttcggactggtctgaaatttatgtaatggataccgaaagcggaaaactgctggaagaccacatcgaatgggccaagttcaccggtgctgcctggcagggagacggtttctactacagtgcctatgatgcaccgtccaaaggaaaagagttctccaacgtgaacgagaatcacaaaatctattatcacaaaatcggtgagccacagtcaaaagataaactgatttatcagaatcctgcttatccgaaacgtttctatacatcgagcaccagtgaagacgaacggattctcttcctgacggaatccggcgccggaagaggtaacaacctgtttatacgggatttgaaaaagccgaattcacccttcatccagctgactacagacctcgactaccaatattacccaatcgaagttatcggcgaccagatttatatttataccaactacggtgcaccgaaaaaccggatcatggtagccgacatcaaccgtccgaagctggaggactggaaagagctcgtacccgaatcggaagctgttctttcaaatgcggaagtgatcggtggcaaactgttccttacttatgacaaagatgcctcgaaccacgcatacgtttacggtctcgacggtaaacaaattcaggaaatccaactaccgtcacttggttccgtaggctttagcggcaacaaagacgacaaagaatgtttcttcggattcacttcattcaccataccgggtgctacctacaaatacgacatggatcaaaatacctacgaactatatcgtgccccgaaagtacaattcaactcggacgattttgtgaccgaacaagtattcttcgccagcaaagacggcgtaaaaattccgatgttccttacttataagaaagatttgaagaaagacggcaaaaaccctgtattcctctacggatacggtggcttcggtatcagcctcaacccgggcttcagcgccacacgcattccattcctcgaaaatgggggtatctacgcacaagtaaacctgcgcggtggtagtgaatacggtgaagactggcacgtagccggaactaaaatgcagaaacagaacgtattcgacgatttcatctctgctgccgaatatctgatcgaccagaaatatacgaataaagataaaatcgccattgtaggaggttccaacggtggtctgttggtaggtgcctgcatgacacagcgtcccgacctgttccgtgtagcgatcccgcaagtaggtgtgatggatatgctccgctaccataaattcactatcggctggaactgggcaagcgattacggcacaagcgaagacagcaaagagatgtttgaatacctcaaaggctactctccactgcacaacctgaagccgggcacgaaatatccggcaacactggtcactaccgccgaccatgacgaccgtgtagtccctgcccactcattcaagtttgccgctaccctgcaagccgacaacgacggtacgaatccgacactgatccgtattgacagcaaagccgggcatggcgcaggcaaaccaatggctaaagtactggaagaacaagctgatatttacggattcatcatgtataatctaggaatgaaaccaaaattctaa

SEQ ID NO: 3197 - DNA, 1692 bp, Bacteroides xylanisolvens
atggcaaatattaaaaatgcagtgaagctgggtgtgtttacccttgctatcatgaatgttacggcagtagtatccttgcgtggactaccagccgaggccgtatacggaatgagttcggccttctattatctttttgcagctattgtctttctaatccctacatcgctcgttgcagccgagttggcagcaatgtttcaggataagcagggtggtgtattccggtgggtaggcgaggcctacggcaagaaactgggattcctcgccatctgggtgcaatggatcgaaagtacgatctggtatccgacagtattaacgtttggtgccgtatctatcgctttcatcggaatgaatgacgtacatgacatgtcactggcaaacaataagtattatacgctcgtcgtcgtacttatcatctattggctggccactttcatctccctgaaaggtatgagctgggtaggtaaagtagccaaaatcggtggtatggtcggtaccattatcccggccggattgttgattatcttaggaatcatttacctggcaacgggcggacattccaatatggatttcaacagtagcttcttccccgactttaccaacttcgataatgtcgttcttgctgccagtatcttcttgttttatgccggtatggaaatgggcggtatccacgtaaaagacgtggaaaatccttctaaaaactatccgaaagccgtatttatcggtgcgcttatcacagtgttgatcttcgttctgggtactttcgcattaggtgtgattatccctgctaaagacatcaacctgactcaaagcctgctcgtcggtttcgacaactatttcaaatatattcatgcttcctggttgtcaccaatcattgcggtcgctcttgctttcggtgtattggctggtgtattgacatgggttgccggtccgtccaaaggtatatttgccgtaggtaaagccggttatatgcctccgttcttccagaaaacaaacaagctgggtgtacaaaagaatatcttgttcgtacagggtatcgctgtaaccgtattaagtttgttgtttgttgttatgccttccgtacagagtttctatcaaattctgtcacagctgacagttattctttatctgattatgtacctgttgatgttctccggagctatcgcattgcgttataagatgaagaaactcaaccgtccgttccgtatcggtaaatccggcaacggcctgatgtggtttgttggcggtcttggcttctgcggatcattacttgcctttattcttagcttcatcccgcccagccagatttctaccggtagcaacaccgtttggttctccgtactaattatcggtgcaattatcgttgtcgttgctccgtttattatctacgcttccaagaaaccatcttgggtagatcctaattccaatttcgaaccgttccattgggaagttcaggctcaacctgccactgcaaatgttagtgcaagcggcgttaatgctccgcgtcctgctaatgcaacttctgcacacacaggaggaacaactggggcaagcacagctacccccggtgcaaccgcttctaatgcagcaacttcaggcacagcatcctccggttcagcttccttcggaagttcctctgccagcaaagcatctccgggaaccggagacaaagataaggatgcacctaagtcgtaa

SEQ ID NO: 3198 - DNA, 2358 bp, Bacteroides xylanisolvens
atgaacaccgaacaaaaccaaaaagcactattagaacagctggaagcgctaaagaaagaaaatgagcagctcaaaaaggagctttctattcttaggaatgagaatataagtaatcgtcccgttagtttcaaagaaaaatatgctgtcaggattctggactctttgccggatatgctgactgtcttcaatcagaacgaagtaggcattgaagttgtttccaatgaagaaaccaatcatgtcggaatatcaaacaaagattttaagggaatgtatatgcgggaaatggttccaccggaagcatatcagaatattcactccaatatgcgtcaggctgtcagcacgggagctgtttcaaccgcccatcatgaattggattttaatggtgaacatcatcattacgaaaatcgtatctttccgttggatgaggagtatgtattgattatgtgtcgtgatataacggagcgggtgaccacgcaaaggcaactggaggttttcaagagtgtactcgataaagtgagtgacagcattcttgccgtatcggaagacgggacattggtttatgcaaataagcaatttatagaagaatacggagttacccaacagatgggtatccaaaagatatatgatctgcctgtctctatgacaacaaaggaggcgtgggaaagacgtcttcaggaaatacgtgacaatgatggcacttttgcttatcgtgctgcctatatgcggaaaggtgaagataaagagcggatgcatcaagtatctacatttctgattcgtgagaataatgaagaactgacttggttctttacacaggatattactgatgttataaagaaacaggatgaacttcgcgaactaaatctattgctggatggtattttgaataatatcccagtctatttgtttgtgaaagacccggaaaatgattttaggtatttgtattggaacaaagcatttgccgaccattcaggtatcccggcgtctaaagcgatcggacatacggactatgaagtatttccgagtcatggagacgcagagaaattccgtaaggatgatttggaattacttcagacccataagcgtattgatatgcaggaaacgtatctttccgccactgggaaagcgcgtattgtacagacattaaaggcgcttgtgccgatggaaggacgcaaaccgttgctgattggtatctcttgggatattactaatcttcagaatattgagcaggaactgataaaggcaaggattaaggcggagcaatccgaccgattgaaaagtgctttccttgctaatatgagccatgagatccggacaccactgaatgcaattgtaggattctctcaattattgcctgctgccgaaactgctgaagagaaaaagctctattcgggtattatcaatcagaattcggatattttgttgcaactgattaatgatattctggatttatcgaagatagaagccgggacactggaatatatcaagcgtccaatgaatctgggagaagtttgccggacaatttatgctgttcataaagaacgtgtgaaagaaggggtaactcttgtttttgataatgaggatgagaatttattcattgagggagatcagaaccgtatcatgcaggtgataacgaatttcctgactaatgcgagtaaatttacgtatgcaggagagattcgtttgggttttgagcggacggataaaaatattcgtgtatatgtgaaggatacaggaataggaatagagccggaaaaagtagaccatgtcttcgagcgttttgtcaaactgaactcttttgctcaaggcacaggattagggctatctatctgtcagatgattatcgaaaagatcggtggagaaataggggtgacttctgaattgggtaaaggctctacgttctatttcacgattccttatgaagaagccggagaactcggcgaaatctttaaaatgtcaaagacggaatctaaaggaaatactgtaaatcgtgtgcaacagatcaaaaagattttggtagcggaagatgtagaaagtaatttcatcctgctgaagaatctgatcggcagggaatatacattgctttgggctaaggatggggtggaagccattgaaatgtataagcagtatcaaccggacttaattctgatggatataaaaatgccacgcatggatggattggaagcaacgcatatcattcgttcttattccaaagaggttcctattattgctttgacggcttatgcttttgaaacggataaagaattggctttggagatgggatgcaatgattttgtgactaaaccggtttcggaaagaactttgagaaaggctttggataaatattcgactattgtttaa

SEQ ID NO: 3199 - DNA, 1248 bp, Bacteroides xylanisolvens
aacaatatcataatgaccatacaccttatctcatttgcttcaatccttcacaaacaagtctcgctacgtagctcacacgaagctattttaagcgaaattgaaaaatattataccgtaaagctcgtcgattatcaagatatggacaagcttagtagtgatgatttcaaaatcatttttatcgctaccggtggggtggaaagactggtcatacagcaattcgaaaacctcccccgccctgccattttactggcagacggcatgcagaactctcttgctgccgcattggaaatctccacatggttacggggacgtggaatgaagagcgaaatactacatggcgaattacctgctatcatcctgcgtattcatacactttataataatttccgtgcacaacgttccttattcggcaaacgtatcggagtcatcggaactccttcttcctggttagttgccagtaacgtagactacctgttggcaaaacgtcgttggggaattgaatatgtagatattccattggaacggatttatgaacaatttcaacaaataacggatgagcaagtcggagcatcatgtgcagctgtagcatcgcaagctcttgcctgccgcgaaggaactcccgaagatttaatcaaatccatgaggctgtaccgggctattaaaaaggtgtgtcaggaagaaaatctggaagcactgacattgagctgctttaaattgattgaacaaatcgacactaccggatgcgtggcattatctttattgaatgatgacgggataatagcaggttgtgaaggcgatcttcaatctatttttacgctattagcagtgaaagcgcttacgggcaaggacggatttatggcaaatccttccatgattaattcccgtacgaacgagctgatactggcacactgcaccgtaggactcaaacaaacggagagatacattatccgcaatcattttgaaacagaaaaaggaattgccatacaagggttacttccaacaggagacgtaacgattataaaatgcggcggtgaatgtctggacgaatattacttatctactggaacattgactgaaaataccaattatattaatatgtgccgcacgcaagtacgcatccgcatgaatactccagccgagtattttctgaagaatccattgggaaatcatcatattatgcttcatggtaactatgaagatacattgaacgagtttttccaagcaaatgcttgcaaaagaactgaataa

SEQ ID NO: 3200 - DNA, 2574 bp, Bacteroides xylanisolvens
atgagcgtagtgctcgttatttttttattatttttgcagcttagaatctcattccagttttataaaaagaataaaagactcatggcaaagaagaaattagataaggaggcagaacgcactccctcttcccccagtaaaattgtggctgtatgtaagaatgaaactgttcattttgtgattggattgatgctggtcatcttttccgtttacctgttgttggctttttcttccttcttctttacgggggctgccgatcaaagtattatcgatagcggtagttcggcggatttggcggctgttaataatcaggtgaagaattatgccggttcacgtggagcgcagttggcaagctatctgataaacgactgtttcggcatttcctctttctttatacttgtttttctggcagtggcaggattgaagttgatgcgtgtacgtgtggtccgcttgtggaagtggtttattggttgcacgcttttattagtctggttctccatattcttcggatttgcttttatggatcattatcaggattctttcatttatctgggcggtatgcatggatacaatgtcagtcgttggttaatctcacaagtaggagtacctggtgtatggatgatcctgttgataactgctatctgtttctttatatatataagtgcgcgtactgttatttggttgcgtaaactttttgcgttgagcttcctaaaacgcgaaaagaaagagaaggaagaagtcatcccggaaggggaaggcgatcaggaattcacgacttcccaaccgcaggaagtggagttcaatttgaaacggacgtataaacagacacctcctccggcaccagtgatggatatacaggctgaagaacctgaagatgaattccctgtcaaccagccggagccggaagattctcctttgtctgatgaaagtgaaggagtgacgatggtgtttgaaccgactgtttccaaccctgttcccgttgtacaggacgaacctttggaagaggcggaacccgggtttgaagtagaacctgctgcttctgaagaagaatatgagggaccggaactcgaaccttataatcctactaaggatttggaaaactaccgcttcccgactatcgacctgatgaagcatttcgaaaatgatgatccgacgattgacatggacgaacaaaatgcaaacaaagatcgtatcatcaatacattgcgcagtttcggaatcgaaatcagtacgattaaagcaacggtaggacctacggtaactctatacgaaatcactccggagcaaggagtacgtatttctaaaatccgtggtttggaggatgatattgcattaagcctttctgctgacggtatccgtatcatcgctccgataccgggtaaaggaacaatcggtattgaagtgccgaacaagaatccgaagattgtttccggacaaagtgtgatcggaagtaagaaattccaggaatccaaatatgatctgcctattgtattgggtaagaccatcacgaatgaagtctttatgttcgacctttgcaagatgccgcacgtattggtggcgggtgcaaccggtcagggtaagtcagtaggtttgaatgctattattacttccttattatataagaagcatccggcagaattgaaatttgtactggtcgacccgaagaaagtggaattcagcatctattcggtgattgaaaatcatttcctggccaaacttcctgatggaggcgaaccgattattacagacgtaacgaaggttgtgcaaaccctgaactctgtttgtgtagagatggatacccgttatgacctgctgaagatggcgcatgtacgtaatgtaagagaatataatgagaagtttatcaaccgtcgtctgaatccggaaaaggggcataagtttatgccgtatatcgtagtggttattgacgagttcggagatttgattatgactgccggtaaggaagtggaacttccgattgcccgtattgcgcagttggcacgtgctgtcggtattcacatgattattgctacacagcgtccgactaccaatatcattacgggtacgattaaagccaacttcccggcacgtatcgctttccgtgtatctgccatgatggactctcgtactattcttgaccgtccgggtgctaaccgtctgattggtaagggggatatgctcttcttgcagggagctgatccggtacgtgtgcaatgtgcctttatcgatacgccggaagtagaagagattacaaaattcattgcccgtcagcaaggttatcctactccgttcttcctgcccgaatatgtgagtgaagatagtaatagtgaagtaggggatattgatatgggacgtctcgatccgttgtttgaagatgcggcccggttggttgttattcatcagcaaggttccacttcattgattcagcgtaaatttgcgattggctataatcgtgccggccgtataatggaccaattggagaaagccggaattgttgggcctacgcaaggtagtaaggcgcgtgacgtattgtgtattgacgataatgatcttgaaatgcgattgaacaatttacagtaa

SEQ ID NO: 3201 - DNA, 684 bp, Clostridium sp.
atggaacagaatagagatttgtcagctttagaacagaacataggatataaatttaaaaatattaatctactaaaaaatgctttaacacacacatcatatgcatatgaacataaaattgctagtaacgaaaaactagaatttttaggagatagtatattagaatttttatcaagcaagtatatttacaataattatcctaatttaaaagagggagaaatgactaaagttagggctacggttgtatgtgaggacagcctttacaaaattgcagaaaagcataattttagtgatttcttgtacgttggaaaaagtgaacagatgcatcaaggaaataaaaaagtagcaataatggctgatagtgtagaggctgttatagctgcaatgtattttgattctggcttagagcaagcagaaaagtttataatagaaaacttgaaagaagagataaaaattgcaagcaaaaatgttggaataaaagaccacaagaccgtattacaagaaaaacttcaagtacacggaactgttgatattaaatacgagattattaaagaaacagggccagaccatgacaaaacttttactgcagaagtaaaattgaatggcaaagtgttggcaacaggagaaggaaaaacaaagaaacaggctgaaatgaatgctgcagataaggcactaaagaatttataa

SEQ ID NO: 3202 - DNA, 753 bp, Clostridium sp.
atgaaaaaagacgatcataaaatgaaaaacgacaacttttttgaagcctggggaaatgcaacaaacggaataatttactcggcgacaactcaacgaaatattagaattcagcttgtgctagccgttatagtaatggtgttatctttattttatggactaaatacggcagaatttttatgtttgctatttgcagtttttatggttatatttgcagaattgataaacactgcgatagaaactgtggttgatttgtttgtagatgtttatcatccaaaggcaaaaatttcaaaagatgttgcagccggagcggttgtgttggcagcatgcaatgctttagtggttggatattttatattttttaaagaagaaaatttaaaggctattagtgatagcatatttaataatatggtaaagtcaccaatgcatcttgcttttgttgcaattatgttggttgtaatagcagtaatctctatgaaagcaggttgctcaaagaaaactgagaggggagaacttgtaaaagagggatttgtcccaagtggtcaatctgcaatagcatttgcagcactaacagcaatttggctaaacagcaaagatatagtaacatttacacttgcattaattttatcaatactagttgttgaaaatagagttggaagtaatgctagaaccaaagcggaaatcgtttttggagcatgtatgggagttttaatagtactgttaatttatggattaacaatatttaaaattcaataa

SEQ ID NO: 3203 - DNA, 750 bp, Clostridium sp.
ttgcccccaaggggcgtccctaatgggcgaaaaattgccgagaaagggcgaagagaggattttaaaatgatagagtttagaaatgtttctaaagtatatgatactggcacagaggctgtacacaatgctaattttactattaataaaggagattttgcattcttagttggtagttctggttctggtaagtctactttaataaagttaattttgaaagaggaagagccaacttctggtcacattattattaatggaaaagatactactttcttaaagcctaagagagttccatatttaagaagaagtatgggtgttgttttccaagatttcagacttttgccagataagactgtttatgaaaatgttgcttttgcaatgtatattgtaagggctacaccaaaacatataagaagacaagtgccaatggttcttgcaatggtaggcctttcagataaagcaaatgtatatccaaatgagttatctggtggtgagcaacaaagagttgcgcttgctagagcattagtaaacaatccatcaatgttaattgcagatgagcctacaggaaacctagacccagacacagcttgggatattatgaggcttttaaatgaaattaatttaagaggtactactttggttgttgcaacacatgcaaaagatatagtagataggatgaacaaaagagttattcgtatagaaaacggaaatattataagtgataaaaaaggtgggtatgacagtgaagcatag

SEQ ID NO: 3204 - DNA, 558 bp, Clostridium sp.
atggtagcactaattataattgttgttttggttgctattgttattgcattaattgttatgcgcaacaatttggtagtagcaagacaaagagtaaaaaatgcttggagccagattgatgtacaacttcaaagaagatttgatttaatcccaaatcttgttgaaacagtaaaaggctacatggcacatgaatctgatgttttagaaaaagttacaagcttacgttcttcgtggacaaatgctaaaacagttgaagataaagcaagtattgatagttctctttcaagtacattaaaaacaattatggctctttctgaaaattatccagatttgaaagccaatacaaatttcatgaatttgcaagatgaattatctaaaacagaagataaactttcttattcaagacaattttacaatgatactgttacaaaatataacacacaattagaagttttcccttcaaatattgctgctggcttatttggatttaaacctgaagctttattcgaagtagacaatgcagaagctcgtaaaaatgtaaaagtagattttggaaaataa

SEQ ID NO: 3205 - DNA, 1077 bp, Clostridium sp.
atgttgataactgaactagaattacaaaattttagaaattatgaaaagcagaagatagaatttaataataatattaatattttttatggagataatgctcaaggaaaaactaatattatagagtcaatttttatttcggcttttggtaaatcatttagaacgagtaaggaaaaagaattaataaaatacgatgaaaatttcttaaatatcaatttaaaatacaaaaattctagtagagaaggttacataaaaattcaaattgcagataaaaagaatgtgattgttaatggaataaagataaaaaaattgagtgaccttttaggaaatataaatgttgttttatttacaccagatgatattaacatattgaagaatggtccagcacaaagacgcagatttttagatatgatgattgggcaaataagaccaaactatgttcataatttaaatatgtatttaaaggtattagaacaaaggaataattatctaaagcaattaaaatctacaaatggaaattatgatttattagatatttgggatgaaaaacttgccgaatatgcaaataaagtctgtttatatagattagaatttataaaaaaaataatggataagataaatgaaattcacagcaaaataactgagaataaagaggaaattagagtagaatatttaactgattgtgagaataaggaaaagttgcttagtttaattagagaaagaagagcacttgacataattaaaggatttactacaaaaggtgctcacagggatgattttaatatatatataaatgacaatcttgtaaatgtatatggttcgcaaggacaacacagaacagcagtgttatctttaaaaatgtgtgagttacaaattattaaagaagaaataaatgaaagtccaatactattactagatgattttatgtctgagctggatgctaaaagaagaaagaatttcttaaataatattggagatacacaagtaattattacatgtactgatgaaataaaagatgagttcgaaagtaaatccgtattctacgtgaataatggagtaataaaaaaagaacttgattaa

SEQ ID NO: 3206 - DNA, 954 bp, Clostridium sp.
atgaaaacaatagttggagttagattcagaaagcctggtaaagtttatttctttgatccaggatacatacaattaaacttaaaagataaagtcgtggttgaaactacaatgggagaagacgtaggagaagttgtaataaataaaagacagattccagacgataaagtttcaacagaactaaaaagaatagtaagacttgcaaataatagagatttaaaaagagtagaagacaacaaaataaaagagcaaaaagcaatgaaagtgtgcaaagaaaaaataaaaaaacacaaattagacatgaacttagtagacgtagaatataagtttgacaatagtaaaataatattctattttacagctgatggacgtgtagattttagagagcttgtaaaagatttagcagctatctacaaaacaagaatagagctaagacaaataggtgttagagatgaagttagaaaaataggtggaaatggtgtttgcggaagagaactatgctgttgctcatttttaaataattttgacatggtatcaataaaaatggcaaaagagcaaagtgcttctctaaatccatcgaaaatatctggaaactgtggaagactaatgtgttgcttgaaatatgagcaagaagtatatgaagacaaaataaaaaaattaccaaaagtaggttcaatagtaaaaacagaagatggagaaggaactgttgttacacaagaggtattgaaagaagcaataaaggtacaatttaggaaagacgacatcacaacatacaaaacatatccagcaaaagacgtaaaagtaataaaaaatgcaagcggaaatgataaagatagtattgataatacagtggatagcgaagagatggcaaacctaaaagaattacaaaaattagaagaactagagaaaagagacaaaataatagaaaaagaagaaaataaaaagagaaacaattaa

SEQ ID NO: 3207 - DNA, 684 bp, Clostridium sp.
atgtgggcagtaatgaaaaaagagcttaaaagctatttctattcaccaattggatatgtgtttataggactatttttagcgatattcagttttatattttacataacaacaataagccaaggtgctgtaacatatcaatatgtatttttctattcagtaatgtatattgtaatattcttaataccacttcttacaatgaggaccttcgcagaggaaagaaaaaatggaacagagcaaatattaatgacagcaccaagaagtgcagtagcaattgtgcttggtaaatttttagcagctcttgttgtaattgcaattacagaattatttacattaatttattttggaattatatgctattttaaaacaccagatattccaacagtacttgttacaatgtttggatttttaataacatcaatggcatacataagcttaggaatgtttatttctagtttgacagaaaaccaaataatagcagctgtttcaacaatagcaatatttgtacttgcatggcttgcaccaagtatttcaactaaattaacagcaatatcattaatagaaaaattctatccttttgcaacaggagtgttcccaataacagaaacaattagtttaatttcaataacagccatgtttgtagcattaacaatggttgttatcaaaagaagaaaattagtaaagtaa

SEQ ID NO: 3208 - DNA, 474 bp, Clostridium sp.
caactgatatgttggaggaaaataaaaatggagaaaaataattatctaatttctgaaatgaaaatcgaagatttagaaaacataaaggatatacttgaagtcgattttgatgaattttggaattacgagactctaaaagaagaattagaatctaatttttcaaaatattttattgcaaagcaaaatgataacatagtggggtttgcaggtttaaaaataattttagatgaagcggatttaatgaatattgttacgaaaaaatgttgcagacatgagggaatagcatcaaatattatggataaactaatagagtattgcaagcaagaaaaaataaaatgtataaatttagaagtaaatattcaaaattctattgcaattaatttttataaaaagtataatttcaaagaagttggactaagaaaaaaatattatgataatacatatgatgcaatacttatgaaattagaattttaa

SEQ ID NO: 3209 - DNA, 645 bp, Clostridium sp.
agcatgagagtgagctttaaaaatccattagttatacgattagatggaaaagatgttacaaaaaataaaaaatatgatttgctgaacaattatgaaggaaattttagaaatactttagagaaaacagctgaattttttactagaaaatataaatgtttagcaatattgggctcagatgaaataagttttatttttacagatcctctagtggtaataagtgatttagataaagaaaagtggaatacatcaaatgaaataatatcagtattttcacagtacttttttgattattttaacgaacataataagcaatctaaagtgttttggcatggcaagtgcttttctataagaaatgaaaaaataaattcatatataaaattcaggtcaagcataataaaaaatgtaatgacaacgtattttttatcaaaatataatataaaaatgggaaaagaaaaacaagaaaaaagagaaattgaatgcaaaaaattacaaggctatgaggtgctagaagacatacaaaatggtgttttatatttagaaggagatagaattgatataattgaattttataaaggaaatataaagaaagtaaaaagcacagaacataaaagcagtgatttgtatatagatttaactaatttttaa

SEQ ID NO: 3210 - DNA, 1149 bp, Clostridium sp.
atgagagtagtaattgctgcggctggaactggaggacatataaacccaggaatagctattgccaataaaataatggagaaagaaccacaatcaaaaataattttcataggaactggtagaggattagaaaaagatttagtaccaagagcaggctatgagctaaaaacagttgaagcatatggaattaatagaaaaatcaatttagataatattaaaagattttgcaaaaccataaaggctgttggtcaagctaaaaagatattaaaagagtttaagcctgatatagtcattggtacaggcggatatatatgtgtttctgtgtgtatggcagcaagccagttaaaaattccaataatattgcatgaaagcaatgcttttccaggagtagctgtaaaggtaatggctaaaaaagcagatgaaatattgctaggcttcgaagaagcaaaagaaagaatttcaaatgcaagaaaaatagttgttactgggacaccaacgaaagtaaattcaaatagattaagtgatgagcaaaaatataacttgaaacaggaaatgaaattgaaacaagatttgccagtagtactattttttggtggaagtcaaggggccaaaagcataaataatgcaatactcggaataatagaaaataggcttaatgaaaagtaccaaatagtttgggcagtaggaccaggaaactatgatgaggtaaaagaaaaactaagaattaagaatatagatattgataatatagagaatacaaaaatattaccatacatatataatatgcaagaggttatggaaatgtcagatttagttgtgtgcagaagcggagcaatgactattacagagattgctacgataggaaaacctgcaatatttatcccatatccatttgcaacagaaaaccatcaagaatacaatgcaaaagtattggaaaaagttggtgctgcaaaaattatattagataaagaattaaattttacaaaattaaataacacgataaataatattgtgaaagacacggaaaccttaaaaataatgggagaatcggcaaaaaaagttgcaagagctgatgtagaggaaaacatatacaaggagatttgtcgaattgtgtcgaaacatgaaacacgaaataacttgccaccagaataa

SEQ ID NO: 3211 - DNA, 870 bp, Clostridium sp.
atggatagaagaggaagaagagatgcagattctagaaaaagtgtaagttttttaacatggggaggtataattttaattgcagtagttgcatttattgtagcgtacgtgttgtacagtaataacttatcaacacaagcaaaaaacataaacaatacacaaaaaatatcatctacagataataatagaatgaatatgatagaaaacacagaagcggcaagcagttctattggtaaaagcgtaaatgaacttgaaaatacaacaaaaagtactacaaatacagaaaatacaaataaaatggcagtaaatacaagcaaaaatgaagaaaataaaaatttaaataataagaatgaaaataataaaaatgaaaaagaagaaaagccagatgcaacaaaaaataacaatgtaaaagaaaatacagcaaccgaaaatgtaacaaatgttgaacaagttgagaaaacaaaagacccaacttttgtaaatccagtagatggtgaaaaaattaaagattattcaagtgacaacttagtatattcagtaactttagatgaatggactactcatttaggaattgactataaatcagaaaagacagatatagtaaaagcctcagcagacggaaaaattaaatcaataaaaaatgatccaagatatggactaacggttgtaatagaacatacaaatggatttgagagtgtttattcaaatttgttaacagcagaatttataactgttggagaagaagtaaaacaggggcaaaccattgcaacagttggaaatactgcaagatttgaaatagcagatgaaacacaccttcacttcgaaataaaacaaaacggagaaaatgtagaccctaatatatatttaaaataa

SEQ ID NO: 3212 - DNA, 588 bp, Clostridium sp.
aaaggtgaaggtatgctagtattattatcaggagtttctggtgctggtaaagacacaataaaaagagaattaataaaaagaaataaaaatattacatctttaccatcttatacagatagagaaccaagagaaggcgaagtaaatggggaaatatataactttatttctacacaagaattcgaagaattaataaaaaacggagacttatacgagtacgatgtacaccacgaccattattatggaacatcaaagcatttattaaatgaacgcttagaaagtggaaaaataatagtaaaagatatcgatgtaaatggaacagaaaatttagtaaaactactaggaaaagatacaagaatagtaacaatattcttacgtgttccaaaggaagaattgcatagaagattattgcaaagaacaccagatgcagatccaaaagagataaccttgcgtttaaatagatttgattatgaagaatctaaaattggtgtatatgattatgtattaaaaaacaataacttagaaaaaacaatacaaataataacagcaataatagaaaatgaaagtaaagtaaaaaatgtagaattttaa

SEQ ID NO: 3213 - DNA, 882 bp, Clostridium sp.
atgtataaattagtagcaatagatttagatggaactttattaaattcatatggagaaatatcagagaaaaataaagaagcaatacaaaaagcaaaaaataaaggtgcagaaatagtaattgcatctggacgaccaatttcatctgcaagaagctatgcatatgaagttggagcagataattatataatttgtggaaatggttctgtattatatgatatgaaaaatgaacaaataatatacgataaatttatagaaagacaaaaagctttacagattattaaaatttgtgaagaaaatagtatattttttaatatatatacagaaaaattaacaatttcaaaatcactaaattataatattttattttacaataatgaaaataaaaatgttccagaggataagaaaaccaacataaaaataatagataatatatataaatatgttgaagaaaatccagatttacaagttctaaaaattactgtttgcgatgaaagtaaaataatttttgatagtataattagaaaactaagagaagtaaagaatgtagatgtacttgatttacaacatatggctagaaagtatattaagcttggcacagaagaaaagaaagttgaatattattatacagaaataactagcaaggatgttgataaatggggagctattgaaaaattagctgatagattgcaaataaataaagaagaaataatggcaattggcgataatatgaatgataaaagaatggttgaaaatgctgggcttggagttatgatggagaattgtgctccatatatgaaagagtttgcagatgtgattgttaaagataataataatgatggtgttgctgaagcaatagaaaaatacgtattaagtgaagaataa

SEQ ID NO: 3214 - DNA, 732 bp, Clostridium sp.
gaaagggatgaattttatatgaaatttataagaagacttttattatttttattaatcataattgtcattgtgtgcagtgtattctatatgaatggaaaaaagttgtatgactcaaaactatcatcaataagtcttgaagataaaatttcatctataaaatcagatgaaagctacgtatctttaaaagatttaccagactattacaaaaatgcagtaattgcagttgaagatcacagatattacaatcatggagcaatcgatccaattgctctagctcgtgcaatagtcagtaacataaaacagaaagaatttaaagaaggtggtagcacaattactcagcaaacagcaaaaaacttatacttcatatctgaagatgatgttgtaagccgtaaagttgctgaaggaattctaagtttcaagctcgaaaaagattactcgaaagacgacatcttagaactatatgtaaacacaatatactttgggaatggatattatgggataaaagaagcctgcaaaggctacctaaaaaaagagccaaaagatatgactctttatgatgccacaatgcttgccggaattccaaatgcaccaagtgtgtatgcgccaacagtaaattttaatttaactcagagcagacagcgtaaggttgtttcatcaatgctagaatataaatatttatctcaagagcaagcagataaattaaataaagaaattacaaatgccaaatggtaa

SEQ ID NO: 3215 - DNA, 525 bp, Clostridium sp.
acacagacaaaattgaatttgttttcaatcaagtccataaaaaaggagaaaaaaatgccttttattgaaataattacagattctaagagccaaacacagcttaataaagtaattacaaagaaaatggtaaatgattgtgatattttgtttattaaagataagaacatagaaaacacaaaaaatataaaactagaaacgctggtattaaacagaagtgtcgaaaatgatgaattaatgagcaaaataatgaaaaattctaagaatttaatattgaatttggatttgaacgaaaatttgcaatatgaagattcgtgcaatgtaatttcatatggttatagctcgaagagtgatataactgtgtctagcgttgaagaagatgaattattgatttgtgttcagcacacaataaggagcatgtttgataaagtgatagaaccacaagaaataaaggttaatgtaagagcagatatgaatgtgtataatataatgatagtaattgcactttcaagtttgtatgcaaactaa

SEQ ID NO: 3216 - DNA, 990 bp, Clostridium sp.
atgttttataacgatggacttatttttacgaagaaaggacagcaaaaaatgaaggaaaattttataacaagtatagtatcaacatggagcaatagtatatctgaatattttaagctattacaagaatatccgattaaactagtatcattaattttggatttagcaatagtcatatttattgtagtaaaaatgttccaaatagcgaaaggctcaagagcattgcaattaataaagggaataattttgttcattcttataacatggattagtggaatacttaatttaacaatagtacactctgttttaacggcatttttgccttctggagtaattgcacttgttgtaatatttcaaccagaaataagaagaggattagaacaaattggaacaaacaagtttacaaatttatttggaatggacaaaagtatagaaactaaaacaagagaagatatctacaagattgtaattgctgtagaagaacttgcaaaaacaaaaacaggagcattaatcgtaattcaaagagacatcagcttgagtgatattatatcaacaggtatagaaatgaattctgaaatatctccacaattattggtaaatatatttgttccaaagactccgttacatgatggtgcagttgtaattaataataacagaattgcagcagcagcatgtatattaccacttgcaaacaatacagatatttcaaaagaattaggaacaagacacagagctgcagtgggaatttctaaagaatatgatgcaatagcaatagttgtatcagaagagtctggaaaaatatctattgcaaaagatggaactctaattgtagatgttaaagaagatgctttgaaaaaaatattaataaaaaatatcataacaaacagattggatgagaaagaaaagaacaaattagcaagattgaagaatattcaagagttaaagaaaaaagataaagaagaaagtaaagaaaataaggaagcagacaaataa

SEQ ID NO: 3217 - DNA, 720 bp, Clostridium sp.
ttgaataaaaaacaaatagcaattactttgggaatagtatgtttaatacttacgatgtttgtagtaattcaaataaggacaacaaataatgcaaacaaagttgtatcacaaacatttactagtaacgatttaagaaatcaagttttaaagtggaaagaaagatatgacacaacatatgcagagcttcaatcatcagaaaaaaagctagaagatgttagacaacaagcaagtgaaaacacagatggttcagatgagaaagaagcagaattaaagaaaaataatatattaattggattaacagatgttacaggagaaggtgttattgtaacactaaaagacaataatactgttacagcagatagcaacatattagatccaagcatggtaattgtgcatatgccagacattttaggcgtaataaacgagcttaaaaatgctggtgcagaagcaatatctataaatgaccaaagagtagtttctacaacatcattaacatgcgaaggaaatataattaatataaatggcgaaaaaattagttctccattcgttataaaagcaataggaagttcaatatacatgaactctgctttaacaagggctggaggaactatagagtatttaaacagatatatacaagcatcggtaaaaacatcgaataatattacaataggcaaatatacgggtgtgcttaaccctaaatatataaaatatacagagtag

SEQ ID NO: 3218 - DNA, 1467 bp, Clostridium sp.
aaaggagctaatatgtctaaagataaaaagcaaagttttatgcaaggaattattacattgatgttttcacaagttataataaaaattttaggcttgttttataaattatatttgacaaataaaagcggttttggagatgctggaaatgctatttataacagtggatttcaaatctatgcactactgttaacgatttcttcaataggtgttccaaatgctgttgcaaaacttatttcagaaaaattatcagtgggagacaataggggagcacagaaaatttttgaagtagcgtttgcctttttctctgtagtcggttttacaggttcagcattattattttgtggaagtgattttatagcaaatgtatggcttcaaattccggaagcaaagttaacactaataatacttgcgccatcaattttctttgtttcgttaatttctgttttaaggggctattttaatggacacgaaaatatgaaaccaatggcgcagtctcaaacaaaagaacaatttacaaaaacaatatgcactgttgccatagttgagttaatatgtttttttatgggaaataaagatactacagctgtaatggctgctggagcaaatttggcaactagtattgccacctttattggctttatatatttaatatatttatataataaaaaagaaagatacataaaatttaataagccaaaatatcataggcaagaaagaacagtagagatagtaaagaagataataataattgcaatgccacttacttttagtgcaattttaggctcactaaataaaaatatagattcctttacagttgtaaggggattaaaaacgtttttaacagaagaacaggctaaaattcaatatggaatactaagcggaaaaatagatacactcgtaacttttcctttatcatttaatattgcacttgcaacggctttggttccagcagtatcggctgcaaaagcgagaggagactataagagtatagaaaaaagggtgtcttttgcgatacttattacaatattaattggactgccctgtagtgttggaatggtagttttcgcaaagccaattttacaaatgttatttccaaatgcaagtagtggagaatttatatttcaaataagtagtatttcgattgtattcattacattagaacaaactataaacggtgctcttcaaggactgggaaaacttaaagtacccgtaattgcactttcaataggagtgtctattaagctaattttgaatttaatattagtaaaagtaaatccagcttcattcgttttgggaggagttgctggagcagcatttgcaactgtaatgtgtcatgttatttccatgtttattagtttgatagcattaagtaaaaatattaaaataaaatttgatttgtcgaaatattttataaaaccaattttagcaagttcatcaatgggaataattcggaatatatacatataa

SEQ ID NO: 3219 - DNA, 1242 bp, Clostridium sp.
atgagagatatggaagaaaaaagtcttagagtttactcagataaaaagttttttactaaattaacaaatactatcacaaaactattaataccaacaaagataggaattaatggaatgttaatttctataaagaggaacaatgttttaaaagcttatgaaaattacacaaatagtgaaaatgtagaagcagacaaaaaggatgaagtagagaaaaaatatgaggatatgttttctctttatcttgaagcaatagataaacacatgatggataatgtttacaaaaaggtaaaaaatgatacagcaacaggtttcgaaagagaagcattgtctaagtattacatggtaattcacttaaaagatactgaatatttggagtataaatacagaaagcaaatattcttaatacagttggattatgacacagtaaaagaattaaataaagaaaaacttacagatagatatgagcatttttatgctagtagaatggaagctttatataaaaaactattgaaaaattattcaataaaattatctgatgatttacaaccaagagaaaaagatgaaatttataataaaatctttggaacagttgaagaatatataacagatattttaccaataaaaatgaaagaagaacctgataataaaatttataaagaaatattatcagactatgaaaacttcgaaagatttacagttggcaaacttgatcaaaatgatgtaattgaaaaaaatatgatattacttggaataagcagaaaattatttacacatagtttgccacttgtaattgcagaacaatgttatgaaaaacttttagtagatgcaagaactttaataatggacacaaaagttattagaaagcaagaaaaagcttatggattgttaatcaacattatagatgattacaatttaaggcttttatctacaaaaatttattgggacaaaccttctgatagggaagaatacaaaaagttttatgctgaatataagaaagttaatgaactaaaagaaaagagttacatggaatattcaaagaataaagaaatattattcttaaaaagagaactaaaagaagtgtacaaaaattataatagatattttagaataattaaattttacaagagaaaactagttgcactaggtgcaatgaaagaattgaaaaacagctgtacatcggaaggatgctacaaaaaagtagaagctgaaacagaaaaagttttagataaagtagtaatataa

SEQ ID NO: 3220 - DNA, 798 bp, Clostridium sp.
atgccaaagggtgaaactataaaagatttatattctgaaattagaaaatgccttttttatatgataccagaaaaatgggaaagcatatatctttatgcgtcagttatacaaagggataatggtgaagaaacaggagaaatgtttttttactattttcccaagagtataataaaaagaaatccaataaatgtgtatcaaattccacaaaaattcaatctaaacgaagaagaatatataaaacttacagatgaattgtataactatataaaaaaattaagacacgaatgccagaaatatgacaagataaactggacaaatataacaatcagtatagaaaatgttgaatttttggcagaatataactgtgaagatttaataaattctatatattcaaatgaagatagaatggcaatttggcagtacaaatatcttgaatatccaatagaaaaatttacaaaatcacagagagaacaaatagaagcatatttgaaagaagaagaacatggcttacatcaatcaaaaatgtatacagaaaccttctatcaacagcatgaacacaatagtatagagtatgatgtaaacaaaaaagtggatgaatatataaaagaagataatgaaacaacagactttacaatggttgatagtgaacagtatcaaatacagtctgggggcttttttaagagaagaaaaaatagattgttaaatgaaagaaatgacatagcacagtttgaaaatacgagttgcaatgaaaacaaagaaaacgaaattgttgtaagaaatcaaatattaaaatattaa

SEQ ID NO: 3221 - DNA, 1347 bp, Clostridium sp.
aaaaataaattttgcccaagaaagggcgtccctattgggcgaaaaggagtgtatgttatgatagacattaaatttttaagagaaaatccagatgctgtaaaacaaaacattaagaataagtttcaagaccaaaagcttcctttagtggatgaagttattgctctagataaagaaagtagagcctgcaaaatgcacggagatgagcttcgttctaagagaaaatctcttagtgataaaattggtagccttatgaaagaaggcaaaaaagacgaagctgaagctattaaaactgaagttaaagctattaatgatgagcttgttgtaaacgaagaaaaagaagaaaaatttgcaagtgaaatcaaagaaagaatgatgaaaattcctaacataatagatccatcagttccaatcggaaaagacgattctgaaaatgttgaagttcaaagatttggagaacccaaagttccagattatgaaattccatatcatgcagatattatagaaaaattaaacggaatggataaagaatctgcaggacgtactagtggtgttggtttctattatttaattggagacattgctagacttcatgaagcaatgcttgcatgtgctagagattacatgattaatgctggtttcacatatgcaattccaccattcatgattcgtagtgatgttgttacaggtgttatgagctttgaagaaatggatgccatgatgtataaaatagaaggcgaagacctatatttaataggaacttcagagcattcaatgattggtagatttaaggaccaaattttaaagaaagcggatcttccaattacaatgacatcttattctccatgttttagaaaagaaattggttcacacggcctagaagaaagaggattataccgtgttcatcaatttgaaaagcaagaaatgattgttttatgcgaaccagaagattcaatgaactggtacaataaaatgtggaagttaagtgtagacttattcagaagttggaatgttccagtcagacaacttgattgttgcagtggtgatttagctgatttaaaagtaaaatcttgcgatattgaggcatggagtccaagacaaaaaaaatacttcgaagtttgtagctgttcaactttaggagatgctcaggcacgtagattagggattcgtgtaaagggtgaaaaaggaaactactatcctcacactctaaacaatacagtagtcgctactcctagaggacttatagcagttatagaaaataactacaacgaagacggaagcataacagttccagaagttttacgtccatacatgggtggaacagaaataataaaacctaaaaataaataa

SEQ ID NO: 3222 - DNA, 1503 bp, Clostridium sp.
gtgaaaaaaacaagatttaagtctgttcgtgtaaagctttttattacactcagtgtcatagtaatatttattgttgcattgctggttataatgaacagcatggtattagagactttttacatggtttctaaaataaattctgtaaaaaaagagtacaataaaattaacgatatgtataataataatgaaagttcaattctcttaaaaataagaaatgatgctctggctaataattttgatataatggtagaaaatgaagattatatgctagtattttctactaacgaaaatttttccaatatgattagtcaaaatttagagaataatagactgaaattgtttggaaaaagagaaagagttttatattcgaataacaatatggagataaaaaaagtaacgacgtctagtctaaatagcatattgttatctggtgaattagataatggctataaaatttatattcaaattccaatttctgcaatagaggagagcgttagaatttctaataatttgttgttgataattggagtaattgctattgtaatagcaggcattgcggtttcgtacgtttctagaaggtttaccaacccaatactagaattgaatgttattgcaaataagatgtctaaattagattttagcaaaaaatatgaaccaacagggtctaatgatgagatagatgaacttggaaaaagtataaatttgatgtctcaaaagttggaaggaacaataaaacaactacgtagtagtaatatagaactagaaagagacatagaagaaaaatctaaaatagatgaaatgagaaaacaatttatttctgatgtatcacacgagttgaaaacgccgattgcattgatacaaggctatgcagagggattagttgaaaatgtaaatgctgatgatgaatctagaaaatactatgcagaagttattttagatgagtctaataaaatggataaattggtaagacaactactagaacttatgaagctagaatatggaaaaagagagtttaacaacgacacttttaatatatgcgagctaatacaggaagtaataagaaaatgtaatgttatgctagaagaaaagggtataaaagaagtaaaatttgaagcagacaaaaaggtaaatgtgtatgctgacgaattctatatagagcaagcgtttacaaactattttacaaatgcaattaagcatacaaaagaagtaaatggtgaaaaatatatagaaataaaattaaaagaagataaagaaaaacataaagtaaaaatatcggtatttaatacaggagacacattgtcagaagaaaatctagaaagaatttggggaagattttacaaagttgatgaatctagaaatagagccgatggtggtacaggaatagggcttgcacttgttaaagcaataatgaataactacaattctaaatatggtgcagtaaatagagaaaatggcattgagttttactttgatattcagacagatgcagtgattgaaaaataa

SEQ ID NO: 3223 - DNA, 801 bp, Clostridium sp.
aaacaagggagaagcataaaaatgaaaaattttgaaaaaataatactaataataattataattgcagcaatagttggaattggatttttaggatatggatattatcaaaaattaactagaactgtacaaaatccagttgcaacaattgaagttgaaaactttggaacaataaaagtagaattatatccagatatagcaccaaacacggttgcaaactttataacacttgcaaaccgcggatattatgacggaaaaacttttcatagaacagttccagatttcatgattcaaggtggttctaaagatggtgatggcaaaggagctcctacaataagtgatattaaagatgaaggctctacaacagaaacatatgcaataaaaggtgagtttatagcaaatgattatagtaaaaacactttgaaaatgaaaaaaggtgtaattgccatggcaagggcagattacagtaacgtaagtagttctctaacaaaaaatggttataattcagcagattcgcaattctttattatgaatgcagataatgataatataaatggattatatgcaggatttggtgaggttatagaaggacttgatgttgttgatgcaattgcaaatgtagaagtagttacaagagaaagcaatgcagatggacaagacaaaccggtagatgaaccaaaaataacaagcataagagttgaaacttatggagttgattatggagagccagaaacaattgaaccattcaattattacaattggttgatgaaacaatactctactacaaagtcttcaaataattaa

SEQ ID NO: 3224 - DNA, 1194 bp, Clostridium sp.
gagaaaaatatgttttttagaattttaataaaatatattcttgggtatattaatataaagattgaaggatattttgttgaaaagtttataaataaatgtataaatgaaaatatatttttctggaatgtaaaaagagagaagagcactattgtatatataaatactggcataaaagattttaaaagactgtgcagaattgctagagaatgtaaatgcaagatacaaattaaggagaaaaaaggattacctttcatattaaataggtatagaaaaagaaaaatatttgcatttttcgttattttaattgcaatattgctaattgttacttctaaatttgtatggaatataagagtagaaggaaataacaaaattaatcaaagtgaaattgtttctatacttgaacaaaaaggattaaaagtagggactttaaagagtagagtcaattcacaagagataataaatgagataaggctggaaagagctgatatcgcttggattggaataagtattgaaggtacaaatgctatagtaaagatagtggaagctgaagctaaacctgaaataataaacgaagaagattattgtaacattattgcaacaaaagatgcacagatagtaaagataagtgcacaaaacggtattcccgtagtaaaacaagatgatgttgtaactaaaggagacattcttattgcaggttggatagacggaaagtatactggtactaggtatgtacatgcggagggagaagtaaaggcgaaagtttggtacacagaaaaggaaaaagtggctttaaatcaggtgattgaagagaaaacaggaaacacagaagaaaaatataaagtaaaaataaataattttacaataaatttgttcaaaacccttccaaaatttgaaaaatatgatacaatagaaacgtgcaattcggtaaaaatattttctaatttttatttgccaatagaacttgtaaaaattacaaattcagaaatagtagaaaagcaaattacctacggaactgaggaagcaaagcaattaagtgtgcaaaaagcatgcgaaaaaatagaagaaaaattgcaaggcaatccagaggtattacaaaagtatgtaaataccaatgtaaataatgattatgtagaggcagaggttacttacgaggtattagaaaatattgggactaaagaaaaaatagtattttga

SEQ ID NO: 3225 - DNA, 816 bp, Clostridium sp.
atgtataggaacaagaaaaccggcataataggagtaattattactattatagttttagttgtaattgtaattatttcaaacataaaaattgaagatttttcacatataggtggagcattaagttcttttgtaatgccagttcaaaatggaattacttacataaagaataaatttagtgggaacagcacatttttctcagaccttgcaactataaaagaagaaaataaaactttaaaagagcgtaacagtgaacttgaaaaatctttaagagaattggaagtaataaagtctgaaaatgaaacattaaaagaatatgtaaatttaaaagataaatatacagaatacacaactattccaggctatgtaattaataaaaatacaagcaattacagcaacataatagtaataaacattggtaaaaatgatggtgtagatgttggaatgccagtaattgccgatgcaggattagtcggacatataatttctgttacagatacaactgcaaaggtacaaactttattagatacatctagtgcggtaagtagtgtagttggaactgcaagagattctgttataataaaaggaaatttagaaaattcaaacatgctaaaaggaacatatataccaacttctgcggcattattagaaggtgacaaggttgaaacctctgggttaggtggaatatacccaaagggaattacaataggaaccgtaaaacaaataatagaaacaaaaaatttaacaaacagatatattttagtagaacctgccgttaattttgataagttggagacggttttagtaattattaaatag

SEQ ID NO: 3226 - DNA, 4461 bp, Coprococcus catus
atgccgcatattaacagagtgcgtgtcaataatgtacgctataatttcggtacacagttttatgatgattttattatgcgctttgactgtaaaaatgtgctgtatgacctggccaacggcggcggcaaaagtgttcttttactgcttttgcttcagaatctgattccgaactgtacgctggatgacaagcagccggtggaaaaattatttcgcggtgaaggcggcagtacggtcatccattcattaatcgaatggaagctggacgattatcttgtcaaagatgattacagatatatgttgacgggattctgcgccagaaaggcaaaagatgatgaaaatcaaaatgcagcaggggacgcagcggcgattgaatattttaactatgtcattttttacagacattacaatgacaatgatatcgtgaatcttccgctcagcgacggtaaggaaagaattacatggccggggcttaaaaattacctcagaaatctttcaagaaaggattaccaactgcaggttcatttattcgagcgcaaaggtgaataccagcgttttatcagccggtatggactgtatgagagcgagtgggaaattatccgtgggatcaataagacggaaggccatgtgcggacctattttgaaagtcattatcggacaacccgcaaggtggtggaggatcttctgatcgaggagattatccagaaagcatttatggcgcggacatcggaacgggctgaaaatggtgataatatgtcgttgatggcggatacgttgtatcagatcaaagatcagttagcggagctgacccgcaagaaagcggaaatcggccagtatgatagacagcaggaagttatgcacagcctgggtgagcgaatccggacgctggatgttatgtatggtgaggaaatgacactgcggatggacattgccagagcatggcagactgtacttgccagacagaaaaacaggactgcggatctggcagcggccagaagagaacaggagctggcaaaggggcatatggaagactatgccagaaagctggagacagtcaaaatccagtccagcaaggaacagctggcctatcttgagaaggaagcggccgactgcagcgaaaagcttgagaagttacagttggaacaggctgtcagcagggatgatctgaacctcagagagagtatgaatgattacctggaatatctggaagaacagcagaaatatcaggccgtggagaatacgatccgtcatagtacggatgggcagaaggagcagctggcacagcttcgggcttatgcaaaggcatggcagaaacgttgccagaagcggatgactgttttggatgaccgtattgtacaaggccggaaagaaatggaaaatcttcagcaaaagctggatgaactggtagcatcagagcgtgaagatgacagaatgctggcggttctggagcatcagtcccaggaaaaccgtgaaaaagagcaaatgtatctgaaggattttgcaaggctgagggaagcatcaggacttctggtgattgaggaagtcgataaggaactgctcagccagaaaaagaaactggaagcaaaggaagctgagctgatgcagctcatggaggatgcgaaagccgcagaggcagaaaaaaatgaacagcagcttcaggaagcccggaatacacagatgttgggacatatcaggacattgatccgtgagggcaatgaatttatggcagcctggcagcgggaatatgagcagatcgccaaactgcttcaggtctatcaggtgacagaagccggtttactcaaggagcatttgtttgcacgctatcgtaagcttgtgtgtgatattgaagaacgtcagagacaggaagctgcactgaaagaaaaaattcatcagttggaagatggcgggctgatgcgtatacctgcggatgttcaggattttatggattatatccgaacatgccatggcattacctgtgtttatggggctcagtatcttcaggaaacaaatgatgcagagcggcgtgcactgcttgcacggatgccgtttttgccgtacacagtgattttaaaagatggttttgcaaaagtagcggcggatgaacttttaaaggaaaaagatttcggggagcatgcgattcctgtggtcagtcttgaaacggtactttctgaagaggagccggtggagaagagccgactgctttttgccggaaaaggcagcagtttctatctggatgaaaatatgcgtcataaagtatgcgcacagagccgggagcagctgacagaacttcagcgggtgattgcccgaatggaggatcagcagcagacctatgaaaaagatatggagtcagtgagcagctttctccttgtctatgatagcaaaaaggaagaaaacagacaagcgcttcgggaaaaccagaagaaagagctggcgcttctggagaaacagaagttgatcaaagaccggatacagcagttggatggacagctgtccggggatgctgtaagtattgaggaagccgggaagcaggcggagacggcaaaagagcagtatgcggtacttgagtcactgcgggatgtcaatacagcattgactgagacaaagcatctgatcgaagaagtcagacagaaatatggaaaattggcggcaaaaaaacaggaggaagaacagaccgcaactttgctgcgcaccaaaatgcaggaacagtcggaagtgtgtgaacatacagtcagtgagaaagatctgctgataaaagactgggaagacaactggaagctttatgctgttgaaacagacggacagcagtttttgggtgaacagccgtcgaaaggacaggtgccggaagatttgacggatgatgcgctgcgggcggccttttatggcattcgtgacgcttatgagaaagaacatatggatctggatgacaaaaagcagctgatggaaagctatgcacgttctatggagcgtctgacaaagagtattgccgatagaaatctccagatggcgcgtatggaaaatctgcgggcggatggccagatttatcagacagcggctgagaatatcaggcagatcaggcaggaccttgagaatatggcacagcaggccgataatatgcggcagcagctgacggctattgaagcggacaagaatcgtctgtacggcagtgttgctcaggcagtcaatgtgattgaggaaaaatacggtgcctataaagaggtggcgttaaatgatcagagttatgaatcctacgtggagaatatgcgtcagctctatgaaaatacttcggcggagtatcgttcgctgactggacgtattgagcgtctgacaaaggaattgtatgcgctggagggaatcaggcatgatgtggaacgcttgatgaagctttgccatgtacaggaaaatctgacaacagaaacattggatgagcagatcggattgaagcgcagatatgaggaacttctgagacgttatgagcagatgcagtcccagtattttgcaaaaagagatgcgtttgaaaaggacaaagccaaagcagtgtcagaactgcatcagttaggtgcagaaggtctggcggcagaacttcgtgaacatctcagccttccggagaatgcagaagcggcaggcagagtgatgcaggaaattgaggaaaccattgccctgatccgtatagagaaagagcgtgtcggaaaaaacatggaagaccttgtcagcatcaaggacagttttgaaagtcagtgtcttcagatttgtcagaacatccggatggaactggataaactgccgaagatgtctgcgattgtcatggataacgagcagattcagatggtcggccttaccatcccttatgttaaagagaatttttacaaagagaaaatgtctgcttatattgatgatattgttaatcaatcggatacccttggaacgcaggaagagaaaatgcgctatatccggcaacagttggcctggaagcggctgttttcggtgattgtaacagatatgaatgccattcggctgacactctacaagagagagagaattgccagccaaagtcgttatctgaagtatgaagaggcggtgggcagtacggggcagtcccagggaatttatattcagttcctgattgcagtgatccattatatttcagctattcatgcaggcgcggctgcaggtgcgcatctcaggaaagtcctgtttattgataatccatttggcgcagccaaggatatttatatctgggagcctatttttgccttattaaaaaccaatgatgtacagttgattgttccggcaagaggtgcaacgccggcaattacaggtaaatttgatgtcaattatgttttggggcagaagctgatgaatcatcgtcagcagacgatcgtcgtagattatcactccaatgtgaagattgacgaaatggaatatgtgaagattaattatgagcaggaagtttttgactttgtttag

SEQ ID NO: 3227 - DNA, 3540 bp, Coprococcus catus
gtgaaagaaaagattcagttattgtcaagaggcgtatttgagtatgagaatccggagattgaagtatcagagaaggagattgctctggaagttgaggcgggcagccactattcgggtacgattcaattgaacagccgcaatcatattgaaatacgcgccatgattttctcatcgaataaatggatgcagtgcctggagtctacagtgatcggaacaacgggatgtattcattatgtttttgatacacaggcattggaaacaggtgaagtgtgcgaaggatgcttttatattgtgagcaatggcggtgagatcacgattccgtacagagtaaaggtatgcgcgcttttttgcgattccagcatgggcccgatgaatgacctggatcagttcgcatccctggccagagacaattggtcggaggcactgaagatatttaagacaccggaatttgggcgtgtttttttgcataataagaagaatcggcggatttatgcggcacttattaagggcagtgatatgtcactggcaatggaagaatttctgtgtacagtgaagcggaaacaggcggtacagatgagtgtgtcacaggatttgattgaattcgataatcttgagcatcccgtcagcgaacatctgctgatcgagaagaaccagtggggacatgtgaatattcacgtttcaacagagggggatttcttaagcgtttataagaagactgtgacggatgaggattttttgggaagctattatcagttggagtacaatattgtgccgggaatgcatacagtggcttccggcaagatcattcttgagacgctgaatcagcgtattgtggtgccggtatgctgcagacgtgagaaagccagagatgtggattttattgagagaaagacgttgaaggcttcgtggatgcatttgtgcaggctgtatttgaagtatgcgctgcatcagattgacaggaatcagatgattggttatgccagagaggatattaatggctgtctgaataacagcagggatattcttttcaaggttgttgaagcggattttctgcgtgaggaaggcaagaacgaggaagcacagaagattctggatggtatcaatggccgtgagctgagatatcgttctgcagtcgcatacagttattttctctatgtgaatgcgctgtgcagacaggatgaacattatacggagtacgtccgtgattctattcagttttatgaggaaggtcaatatcatgaccgatgggaactggtctatatgctgatgaagctggatgcaagggaagaacagcaccagcttaaggtactcagacagacgaaagcgctctatgacaggcatctgatgggcgggctcatgtatttggaggctgttaagataatcaataaggatccatcgctgattcgggaaatgggtgcttttgagatcagtctgttcctttggggaatacgtcatgattgcctgaatcgcgaaacgattttcagatttgcggatcttgtcctgcgcatgcatgtatatcacggacagtgtctgcatgcgatgatcgagatgtgttcattgtatgagacaaagaaccttctttcagcagtcctgcatctgctgattctcggtgagaagaaggatccgatctaccatcagtggtatcagctgggcattaaatcttccatcaagatgcagggactgtacgaatactatatggcgacactggatatgaagaattgcagggaattgccggttccggtactgatttattttcagtatgataatcggctgcaactgaaacagaaggcatttctgttcagatatgtgatcgagcatgagcaatggctgggcaaattgttcgaggcatatgacggtattatcaaagcctttacttttgaacagctgcagaagggtgttattaatgaggacattgccgttttgtatcatcattatctgacgaaggaagcgatgacgccgcatgttgtgaaggggatgccggcgattatttttaagcatcatattcattgtgatcatccgggaatcgtgggtgtgattattgattattccgagctgggtgaggagaagtattatccgctgaatcagggggatgcttatgtggatctttatatggatgattatcggattgtacttgtggatacccggggcggacgctatatgtcaacaatcccttatacgattgacagactgatggatgccggccgttatatcaggatctgctatgagcaggggcgggataataagatgctggtactcaacagaagtgaacgtgcattgaaatatcagatgatggatgatgtatccattgaaacatacaaatgcgttctgagcctgccggatgtaagcagacattatcagaagacgatcctgaagaatctgatcgattattattatgataattatgagggagagacccttgagaaatatttgcttcagctggatatccagcttctgggccattcagagcgcagccatattattgaatattttattcagagagggctgtttgacaaggcttatgaagctatccgggaatacggatacgaaggcattcaggataaacggatcatgcggctttgttccagagtcatccgggaaaagaatttcgcaaaggatgaactgttggtggaattagcctattttgcattttccaacggcaagtacgacgagacgattctgcagtatctgatcatgttttatgcaggaaccacagagcagctgtatgcgatatggaaggcagccggtgattttgaagtgccggcggaacagctggaggagcgtctgctctgtgagatattgtttacggagaatcatgtggccgagggctgtgacgtttttgtttcttattatcatacacatccgggacatcggttgatccgggcatttctcggatattatggctatcattatctggttcatggacagacatccggagagaagattttccagattatggagatagagctggatcaggtggagaatgcccgagatgtatgcgctctggcgctgctgcagtattattcggaggcagaccatgtagaaccggaattttatgagaaactgcagcaggaggtagctgcctttatggataagggaatccttctgccgtttttcagaaaatatgccgggaatgccgaggtgccggaggaattggctgattttctctatgcagaatatcataccagtccgaaagcagcggtgacaattcattaccgtctgcatcaggagtttgagacggagtggatcaatgagccgatgcgccatattcttgggggtattttcatcagaaccttcagactgtttgcaggtgaggagatagaatactatatctcagagcaggatgaaaatggggagaaaaccggtgagaaacatttactgcaaagggaagaggccatggatgcatggccggaaaccggtgtggaactgctgaaccggatgaatcatgcaatccagacagaggacagccaggcagtgaatgaaatgatctgttcgtatgagagaatcaatgaaatgacagagcagttatttgaactgaaatag

SEQ ID NO: 3228 - DNA, 3567 bp, Coprococcus catus
atgtttttaaaaagtattgaggtacagggctttaaatcctttgccaacaagatggtttttgaatttcataaaggcattacgggcattgtagggcctaacggcagcggaaagagtaatgtagcggatgcagttcgctgggtactgggtgagcagagtgccaaacagctgagaggatccaagatggaagatgttattttttccggtactgagagcaggaaacctctgggttttgcctacgtggcgatcactctggataattcagaccatcagctggcagtggaatatgatactgtgacggtatcaaggcgtgtgtaccgttcaggagaaagtgaatacaagattaatggccataactgcagattgaaggatgtgcaggaactgttctttgatacaggtatcggtaaggaaggctattcgattatcgggcagggccagattgacaagatcctcagcggtaaaccggaagaacgaagagaattatttgatgaggcagccgggattgtcaagtacaaacgtcgaaaagccctgacagagaagaatctggcggaagaacagcagaatctcagcagagtgcgggatattttgtacgagcttgagaaacaggttggaccgcttgagaaacagagcgagactgcaagaatttatctgaagcacagagatacactgaagcagtatgatgccaatatgtatctgttgtctttttaccaactgaaaaaagatagtgctgccatcgatgagaaaatggatattgtcagtacacagctgaaggatgcccaggagaattttgagaagatcaaaagtgcgtatgcccagatggaagcgctgatggagcagtacgatcagaagatttcacaagatcaggaggtctgcaatcagcaggctttagaaaaacagcgtcttgaaggcggcaaaaatgtgctggtttctaagacagacggcatcagcagcaaggaagaacagtttgatgcattgatccttgagacagaggcgggaatcgaagagaagaagaaactttccgaggaaagtgagaaagaactgaaagccctggaagaggaactgcaggaactggagcagcataagaacagctctgaagaagcattgaacagtatgtccggtacgatgacatcattgcgagatcagattgattcacagaacagtgatattattgaatttctgaatgaggcggcgaatattaaaggacgtatgcagcgttatgagacaatgcaggaacagacacagatcagacagtctgaattgaatcagaaactgatcgcacttcaaagtgaagaatcttcagaaggtgagctggtagaggcatttaagaaggaagcacagggcattgaactggagcttgagaggctgcaggcagaacagtccgcctgcaaaaagagagctgccaaaatttccgatgatctgatgaaatgcagagaggctttcaatgcggctgagaaatctttccatgaagagtcagcacgttatcagacactgaagaatatcacggagcgctatgacggttacggtgtcagcattcgtaagatcatggagcgtaagagtgactataaaggtatcattggcgttgtggcggatattatccatgtcagcaaagaatatgaaattgccatagagacagctcttggcggcagtatttccaatattgttacggataatgaacagacggcaaagagtatgatacagtttttgaagaagaatcgttttggccgtgcaaccttcctgcctttgacgagcatcagggggcgcagggcagagaatgcggacagaatctgtggtgaggaaggtgttattggtctggccagcgatctgatccgtgtggacagtcagttcggacatctggcggattacctccttggccgggtgtttattgtggatcatattgatcatgcgttggcgttggccaagaaatatcgttattctttaagaattgtgactttggaaggcgagtccttaaatccgggcggttcattatccggtggtgcctataagaatacaggcaaccttcttggcaggcatcgtgaaatggaagaattgcagaaacatgtggagacacttcgcaaagagggtgcctcgctgaaacagcagatcaatcagctgcagtcagacaaagacagtaataaagcagccatggagaaaaatacagctgaagaatcccggcttacactccatcaaaatacggtgcgtctgcgtctgaaacaggttgatgagagccgtggtgagcatgcaaaatccattcaggatattaatcgggagacggcccagatcaaaacgcagcaggaacagatcaggcagttcaggcagcagctgacggttcagatggatgaactggaggcaaagaagaagaatgctgaggaactggtgacatcgttgacggccaaactggaagaaatctccgaacaggagaaggatttcaatagtcagacagcagatatgcggattcattatgccaatcaggtacagaagaaatctttcattcgaaagagtatggatcaaaaccgcagcgaaatccgacatttacaggaaaaactggcagattaccgtgcccagaaggctgttttcggaagtgagaaggatgcaatacgaagacagattgatgaaacagaggcccagattgctgctttgacagaagaaatgacaaaaagccagacagtgcttcgccagaaaacagatgaacgcagcaaatatgcagctgagcataaaacattttttgcaaaacgtgaagaattgtctgagacgatcagtcagctggacaaagaacagttcagacttggcagtcagaaagaaaagctggaagagagccgtagccaactcagcagttatatgtgggaagagtatggcctgacttatcagacagccagggaattatcagatgatgcgctgcaggcactgccgttggcgaaactgaaaaaaatgacagcagatgttaaaggacagatcaaagccctgggcaatgtcaatgtcaatgccattgaagaatataaggcagtggccgagcgctatgagacgatgaagactcagcatgatgatatggtggaagcggaagagaagcttgccggcattattgaagatctgaacagttccatgcagaagcaattcaaggagaagttcatgcagattcagaaagaatttgaccgtatattcaaacttcttttcggcggcggaaaaggtacgctggaactggcggatccggaaaatctgctggagacaggtgttattattacagcgcagccgcctggtaagaaactgcagaatatgatgcagctgtccggcggtgaaaaagcattgaccgcgatcgcattgctttttgccattcaaagtctgaaaccttcaccgttctgccttctggatgagatcgaagcggcgctggatgatgccaatgttaagcgttttgcagaatacctgcataatctgacaaaggatacgcagtttattgttattacgcatagacgaggaacgatgaatacagcggatattctttacggtatcaccatgcaggagaagggtgtttcaacacttgtatccgtgaatctgatagaaaatgaattaggaaaatag

SEQ ID NO: 3229 - DNA, 3687 bp, Coprococcus catus
atgagtattcagtggagtgaaaaacagcaggcggtcattgatgcaaggggctgttctgtgcttgtatcagcggcagccggttcaggcaaaaccgcagttcttgtggaaagattgattcgattactgacggatgaaaagcatccggtggatattgagcgcttgcttgtagtgacatttaccaatgcggctgcagcggaaatgcgtgaacgtattggcagagggttggatcagaaattgcttgaagaaccggatcacacagcatggatccggcagaagcttttattgccctgtgcccagatctcaaccattcacagtctctgcttgaagacaatccgtgaacattttgaagtactggatctggatccgtccttcagactgggagatgaagctgaactgaagcttttgaaatccgatgtggcagaggatgtgatggagacttattatgcatcagaaaacagggccttcagagcttttgtggatcgctatgccaacggcaagaccgaccagggaattgcagaaatgatcattgcgctgtatgattattcaagaggatttccgtggccagaatattggctgaagcattgtctggcggcttattcgacagatgaagagcataatggagccgaccaggtgaaagaatttgccatgatgcagctgaataatgtcctgaccaaatatctgccgctttttgaggaagcccgggcattctgtcttgagcccaatggtgtggaagcttatcttccggtgatcgaggatgataaaaagtggtttcagatgcttggtgagtcggaagattatgacggcagcagagaaattttgcacaagatcgtctggaaacgtctgccgagaacggcggcgtccgttgacccgaagattaaagagaaagtgaaggagattcatgcggatttcaaatcagagatagaagggcttagggatggctattttgtacacacatttgaagaactgaaggcggagctgacttatatccgcccgtcggtcaggatgctgatcgaattgacagaagttttcggacagcagtttatggcggtaaagaatgaccggaatatgctggatttttcagacctggaacattacatgctgcagcttctggctgatttttcagaagatgaacaggggcagatgcaggtgaaaccgacatctgctgcagatgaactcagtgaattttatgaagaggttgtctgcgatgaatatcaggacagcaatcaggtacaggaattgatcctcagccttttgtccagagaacgcaaaggtcagtataatcgttttatggtgggagatgtgaaacagagcatttatcgtttccgactggcagatgcagctatttttatggaaaaatatcaccattatgctcttggagaaagtcagaaaacaaggcagcgtattgatctttcacagaatttccgaagcagggaaagtgtactttctggcgtgaattatattttccgtaagatcatgaagaagagtctcggcgggattgactatgatgatcaggcagctctttatccgggaatggcatttccggaggcaaaaggcaaaaatattgcggacaatacggaacttctgtttctgaagggagacggtgagacgacggagccggataatgagagcctggattctgtggagcttgaggcgaagctggcggcagtcaggatccgggaattgacagatccggagtatggaatggatatttatgacggtgcgcttggagattacaggaaagctgggtacaaagatattgtcatacttcttcggacggtgacaggatgggctgagaagtttgtggatgtgctggcttcagagaatattccttccacggctgaaatgtccgccggattttttgacacgctggagatacggacaatgcttcagttcctggcaattgtcgataatccggggcaggacatcccgctggcagcggttttgtgttcgccgatcgccggtatttcttcggaagagatggctctgatccgttccaaacattcagaaggcagtctgtttggcgcatgtatggcatgcagtgaagagacaccgggagcagcaaagcttaaaaagtttcttgcgatgtttcatgatatccggcgagcttctgtttatctggaactgcatgagttgatccgctatatctatgatcggacaggctattatgattatgttcaggctttgccggggggcgaaaggcgaaaggccaatcttgatctgctgcgtgagcgggcagtggcttatgcggccggcagttacagcagtttgtttgactttatgcgatatattgaacagctcaaaaagaaccagattgatttcggtgaggcggtgatgcctgaaaatgacaaaggccgtgtacggatcatgagtatccataagagtaaagggctggaatatcccattgttattctggccggactgggcaaaaaatttaattttcaggacagcatcagcaagctggttatgcatgcaaagagcggcatcgggttggatgcggtcaatcttcagacacgcaaaaagatgacatctgcctataagaaatttattgcggcccgactgaatctggaaacgctggcagaggagcagaggattttatatgtggctatgaccagagccaaggaaaaattgattatgaccggcatggagagcctgaaaaataccgacaaaaagcttgaaatctggcagagaaacagtggaattttgggtgaagtttttcctgactggatgctgacatccgccaggtcttatctggactggatcatgccggctgtaatgaacggagaagccgagaacgttgtgacgttcagaatggtggatatccgtgcccttgccggccgtgaagtggggcgcgttatagataaaaaatggcagaaagaagaactgcttcagcgaaagcatactttgcccgacgtgtcggagacggacgtttctaaacgacttttcggggaagaagcatggcagtatcctcagaaagcattattatcagtcaaaggcaaatattctgtttcagaattaaaaaaatatgccatggaagcaatcatggaagcggcaccggcaccggggatggccctggctgaaaagcaatcagaaacagaagaggcgctgcctgattttatgaaggataaggaagcggatgaaacacacgaagtttcgaatgtcggggctttccgtggtacagcttatcacagggcactggaactgatcgattttgcggggcgtcctgatgaaagagatgaagcatggctgcgcagtcagctaaatgcgatgacatctgcagggcgtttatccggagagcagaggcaaagtatcaggattcgggatatcgctgatatggtgttttcaaatctggggcttcgaatggcagaggcggatagacgtcatgaattatatcgtgaagcgcagtttgttatgggtgtgccggtatccgcactgtatccggaagtggacagtgaagaaactgttttgatacagggaatcatagatgcttattttgaagaaaatggggaactgattctgttggattacaagactgaccatgtctcaaaacaagacggtgcagatattttgaaaaaacgttacaagcggcagctggatgattatcagcaggcactggagcagatgcttcagaaaaaagtccgtcagaaattgatttactcatttgcattaaagtgttggattgaaatttag

SEQ ID NO: 3230 - DNA, 3225 bp, Coprococcus catus
atgccacagagaacagacattcataaagtacttattattggttctggtccgattattatcggtcaggcctgcgaattcgattattcaggcactcaggcctgcaaggcattgaaaaaactgggttatgagattgttttggtcaattccaaccctgcaactattatgacagatcctgagacagcggatgtgacgtatattgaaccgttgaatgtggaacgtctggaagagatcattgcaaaggaacgtccggatgcgcttttgccgaatttgggcggacagtccggtctgaatttgtgtgcagagctgaataaggccggtattttggataaatatcatgtaaaagttattggtgtacaggtggatgccattgagcgtggtgaagaccgtattgaatttaagcatgcgatggacaaacttggtatcgagatggcgagaagcgaggtcgcttacagtgtggaagaggcccttgctattgcagataaactggattatccggtggtccttcgtccggcttatacaatgggtggcgccggcggcggccttgtttataataaagaagaattaaagactgtttgtgccagaggtcttcaggccagtcttgttggccaggttcttgtagaagagtccattcttggatgggaagaactggaactggaagttgtccgcgataaagataacaacatgattacggtatgttttattgagaatatcgaccctctgggtgtgcataccggagattctttctgtgcagcaccaatgctgacaatatctgaagaatgccagaaacgccttcaggaacaggcttataagattgttgaatctgttgaggttattggtggtacaaacgtacagtttgctcatgatcctgtgacagacagaattattgttattgagattaatccacgtacatcacgttcatctgctctggcttctaaggccacaggtttcccaatcgctcttgtgtctgcaatgctggcaacaggcttgacactgaaggatattccttgcggaaaatatggtaccttggacaaatatgtaccggatggagactatgtggttatcaagtttgcacgctgggcttttgagaaattcaaaggcgttgatgataagcttggcacacagatgcgtgcggtcggtgaagttatgagtattggaaagaactacaaagaggcctttcagaaagccatccgaagtcttgaaacaggccgttacggtcttggtcatgcaaagaattataataccatgacaaaggaagaacttttacatttgctgattaatccgacaagtgaccgtcattttattatgtacgaagctatccgcaagggtgcaacaacagaagagattttcaatctgaccaaggtgaagacatactttattgagcagatgcgtgaattggttgaggaagaggaagaaatccttaagtccaaaggtcatctgctggcagatgcacttttgatccaggcaaagaaagatggcttctctgataaatatctgagccagctgctggagattccagaggaagaaatccgcaatcacagaattagtcttggggttgaagaagcatgggaaggtgttcatgtcagtggtacaaaagacagcgcgtattattattccacttacaatgccaaagacaagaatcctgtgtctgaggcaaaaccgaagattatgattctcggtggcggtccaaacagaattggtcagggtatcgagtttgactattgctgtgtacatgcagctcttgccttaaagaagcttggttttgagaccattattgtcaattgtaatccggaaactgtttctactgattatgacacatctgacaagctttattttgagccgttgacactggaagatgttctcagcatttataagaaagaaaaaccattgggcgtgattgcccagtttggcggtcagacaccactgaatctggcagcagagcttgagaaaaatggcgtaaagattcttggtacagcacctgcagtcatcgatcttgcagaagatcgtgatctgttccgtgccatgatggaaaaacttgacattccgatgcctgaatccggcatggcaacaaccgttgatgaagcactggagattgcaaataagattggttacccggttatggtacgtccttcctatgttcttggcggccgcggtatggaagttgtctatgatgatgagagcatggcaggctatatggcagctgcagttggtgtgacaccggacagaccaatcctgatcgaccgtttcctgaatcatgctacagaatgtgaggcagatgccatcagcgatggaacacatgcctttgtaccggctgttatggagcatattgaactggccggtgttcattccggtgactctgcttgtatcttgccttctgtacatatttcacctgaaaatgtggcaaccatcaaggaatatacaagaaagattgccgaggaaatgcatgtcaggggcctgatgaacatgcagtacgccattgagaacggcaaagtgtatgttctggaagccaatccgagagcatcccgtacagtgccgcttgtatctaaagtctgcaatatccgtatggtgccgttggcaacagatattattacatcagaattaacaggtcgtccgtcacctgttccggaattgaaagagcagaagattccatattatggtgtcaaggaagctgtcttcccattcaatatgttcccggaagtagatcctgttctcggaccggaaatgcgatcaaccggtgaggtacttggattatccgagtcctacggcgaagcctttttcaaggcgcaggaagccgcatctctgaaactgccgttggaaggcacagttttgatctctgtgaataagaaagataagccagaagtcgtggatgtggcaaagcgtttccatgaagacggctttaagattattgcaacaggaaagacctgtgatctgttgaatgaatccggtattccagctgaaaaggtgaagaaactttatgaaggacgtccgaacattctggatatgatcacgaatggcaagattgaccttgtagttaattcaccggcaggcaaagaaagtgtgcatgatgacagttatcttcgtaaagccgccattaaggcaaagattccatatatgacaactatcgcagcagcgaaagcaaccgctgagggcattggttatgtgaaagcacatatggaagaaaataatgtagttaaatcactgcagcagatgcacagtgaaattcaataa

SEQ ID NO: 3231 - DNA, 3537 bp, Coprococcus catus
atgaaagcgtttacacagccattacatgatttaagtgaatatgatcagatcgtcagcgatcttgccggacagcggacaccaattcatatagatggctgtatagattcacagaaatgccatctcatcagcagtatcggagaaccttatccgtttaagctgatcgtcacttataatgagattaaagcaaaagaaatttatgaggattaccggttttttgaccgaaatgtttattattatccggccaaagacattattttttataacgcagacattcacagcaatctgatcgtcagtcagaggatggacgtgatccggcgaatgatggatagatgcccggttacagtggtgacaactattgatggtttgtcagacagactgctgccgttggaagaacttcagaagaaccgatgtgtttttaaggtgggagatattctgccactggaagcactcagcaggaaattgacggcgcttgggtttgaaagagtcagtcaggtggaaggtccgggccagtttgcggtccgcggtggaattcttgacatttataatctggcggatgagtgcccttatcgtgtcgaattgtggggagatgaaatcgattccatcagaagttttgatgcagagagtcagcggtctattgaacaggttgatgaggtgacaattgatccggctgccgagtatattatgagtgtatcggtacgggatcgtggattgaagctgatcgatcgggacatgaagcagcagatgcagagattgaaggatgccgggaattatgaagcggcggccagattgaaacaggcagttgcggaattgaaggacaatctggaattgagcagcgcagcttcaggtatcgatagtcttgtgcagtatttttatgaccatacagtttcatttttggattatttcacggaaaaggatagtctgatcatcctggatgagccggcccgtgtggcagagaagggggaggctgtaacggcagaatacagagagagtatgatgggcaggctggaaaagggctatgtgctgccgggacagacagaggccatttatgaatgtcggaagattctggcacggatgggaaatctgcggacggttttgctcagtacgctttcctataattcagcgcatattgcagttaagagtaaatacagtatgatgaccagcagcatgcatacctacaggggggattttcagctgttggtaaaagaactgacaggatggaaaaacagcggttatcgactgattcttgtctgccgttcggagacaagaggcaaacgtcttgtcaaagaccttgcagagtatgatctgttggctttttattcagaagacagggaccgggtgccggcgcctggagagattatgattattcacggcagtcttcataagggcatacagtatccgatgatcaaatttgccattatcgcagaatcagatatgtttggtgaagataagaagaagcggagaaaacgccgacagcctgcatcggagggagagcgcatcagaagcttcaaagaactgtctgttggggactatgttgttcatgaaggacatggcgtcggtatttaccggggcatagaaaatgtagaagttgacggtgtggccaaggattatatcaagatagaatacggcggtggcggaagcctgtatattttggcgacaaatctggacatgatccagaaatatgcggataaagataccaaacaagtgaaggtcaataaaatgagcggaccggagtggacccgtaccaagacgaaggtaaaaggggcggtcagagagctggctatggatctggtaaagctgtatgctgcccgtcaggagtcagaaggatatgtctgtggcccggacactgtgtggcagcgggagtttgaagaaatgtttccgtatgaggagacgcaggatcagctggatgccatagaagcaacaaaacgtgatatggaaagtacaaagatcatggatcgacttgtctgcggtgatgtgggctttggcaagacagaagttgccattcgtgcagctttcaaaatggtgcaggagggacggcaatgcgcagtgctggtgccgacaacgattctggctcagcagcactacaatactttttgtcagcgtatgaaggaatatccagtgaatattggacttctttcgagattcagaacaaaggctgaacagaagaaaacactggaagatctcaaagccggacgggtggatattgttattggcacacatcgtcttctgtcgaaagatgtagagtttaagaaccttggtctgctggtggtggatgaggagcagcgatttggtgttacccacaaggagaagatcaagaaaatcaaagagaatgtggatgtattgacattgacggccactccgattccgcgaacgatgcatatgagcctgatcggtattcgggatatgagtctgctggaggaagcaccggtggatcgtcagccgattcagacttatgtgatggaatataatgatgaattgatccgggaggctatcatgagagaactggccagaggcggtcaggtgtactatgtgtataacagagtcaatggtattgatgaaatcgctgcgggattgtcagaacttgtgccggatgcttcagtggcctatgcccatggacaaatgagtgagcgtgagctggagaaaattatgtatcagtttattaacggggaaatcgatgtgcttgtctcaaccacgattattgagacagggcttgatatttccaatgtcaatacaatgatcattcacgatgcggataaacttggactttcacagctttatcagctgagagggcgtgtcggacgatccaacaggacatcctatgctttcctcatgtacaaacgtgacaaaatgctgaaggaagtggcagagaagcgtttatcggcaatcagagaatttacggaattgggctcgggataccggatcgcaatgagggatctggagattagaggtgcaggtaatctgcttggtgaacggcagagtggacatatggaggctgtaggatatgatctgtactgcaagatgcttaaccaggctgtgatggaggcgaagggcgaaaagattcaggaagacttcgagacatctgttgatattgatattgatgcttttatcccatctgcctacattaaaaatgaatttcagaagctggatatgtataagcgaattgcgtcgatacagaatgcggatgaatatggtgagatgttggatgagctgatcgatcgtttcggggaattgccgaaaccggcggccaatctgcttcttgtggcgctgatccgtgcagaggcccatgcagccggtgttgttcaactggtgcataaggaaaaagaaacccggatctatatgcatgagcgtgcagacgtggacgttgcggctattccggattttctggctgagtacggcagaagaatccagtttaaggcaacagcaaagaatccgtatttccttgtaaatatgaatggcttcaaaggtcaggggctgcttttggaagaaaaatcattggtagagaatatgctgagaattctctgccataaagagcttaattag

SEQ ID NO: 3232 - DNA, 4389 bp, Coprococcus catus
atgtctaatcttactacaaatgatacacagcttttcgttggtattgatgtaggttccacaaccaccaaaatcgttgccatcaatcccgaaaagcatgaaattttattatctaattataaacgccacaacgcagcccaggcccagagtgtacaggatgccctggcattttttgaggataaatttccaaatgcccgtatccgtctggccctgacaggctccggtgccaagcatctggctgaagctcttggctgctgctatattcaggaggttgttgccaattccatcgccctccagaaggaatatgacaatgtgggaaccgccatcgaactgggcggtcaggatgcaaagatgattttcttccgccgtgacccggccacacagacgctgaatgtagcggatatgcgtatgaatggcagttgtgccggcggcacaggcgcttttatcgatgaaattgcttctatactaaaggtacctgtagaagaattcaatgaactggcctctcagggcagctgcatttatgatatttccggccgctgtggtgtttatgccaagacagatatccagcccctgctgaatcagggtatttcccgccaggatctggcactgtcttctttccacgctatcgccaaacagaccatcggcggtctggctcagggtctggatatccagaaacctgttgtttttgagggtggtccgctgacctttaacccaacactggtaaatgtttttgcaaaacgtcttggcctcacaccagaggaaacactgcgtccaacccatcctgagattatgatcgcctatggcgcagctctttctctggacggtatgtttgcaggcaattcttcatggtatatgccaaaacattatcttgagctgttggagaatccggaacttcgtgcccatttgcaagcttctgcagatggtccgctgtttttcgaatccgaagaagaacatcgtgcatttaatgaacgccatcaactcccagaatttacaccctatgtgccgcaaaagggcgaaacggtccatgcttatcttggcattgattccggcagtacgaccacgaaatttgtgctgatggatgaggatgaaaatattctcgattctttttatgcaccaaatgaaggtgatccgctgactattgccaagacagccttgttgaccatccatgaccgctacgaaaaggctggtgccaaactggatatcattgccgcaggtacaacaggctacggcgaactgctgttttcaaaagctttcagcacagaatgccatgttgtggaaactgttgcccacgcccgggctgccgacaagtatatcaaagatgccacatttatccttgatatcggcggtcaggatatgaaagccatctggattgacaacggcattatcaccaatattgttgtcaacgaagcctgctcctcaggctgcggttccttccttgaaaactttgcttcatctttacatattcctgtggaagaaattgccgaagccgctttttcatccaaacatccggcttctcttggcagccgctgtacggttttcatgaacagcagcattgtcacggagcagcgaaacggcaaacaatctgcagatattatggccggcctgtgccgttccatcattgaaaatgtttttacaaaggttatccgaatctccaatttggacagtctgggcgacaagattgttgtccaaggcggtacattcagaaatgatgccgtacttcgtgcccttgagcagtacaccggtcgtgaagtcatccgtgccccttatcccggcattatgggtgccatcggcgctgctctcattactaagaaacgctttgaacagaatcacccagccaaaacatttatcggtattgacggtatggctgatttttcctatacacaagaagccaacgccccttgcccgttctgtgccaaccattgtaaacgaaccattgtccgtttttccaacggcaattcctgggtaaccaacaaccggtgcgaacgcggcgaaatcctcggtgatccgaaggatgcttctgtccgacagcagcttgcagatgcaaagaaatcccgtgaacagacaccaaatctcttcaaacttcgacaggaactgttgtttaaagactacccttatccgaaagctgctaaagaacgtgacatcaccatcggtctgccccgggtgctttcctattgggaaaccatgccattctggaccaccttctggcgtgctctgggatttaagattcaattgtccgatctgagcacacgcaaaatttacgaagacggattgtccgcagtcacttccgataccgtctgcttcccagctaaactggtgcacggtcatctgcgcaatctggtaaaaaaagatgtggatcgtattttcatgccatccatcacaacagtaacctctgaaaatacagagagcaccagcgaatctatgtgtgccatcgtcaaaggctatccgattgtcatccgtaactccgataaccctgaaaagcgttggcatataccatttgacgcaccacttttccactggtacaagcgcgaggacagaaaccgtcagctcaccggctatatggagaagactttcggcatttccccggcagaaacccgacaggccattaacgtcgccgatgccgctgaaaaacagtttcatgatgaaatgcatcgggcgggaaaagctgttcttgatgaagtcactgccaatggcagctatgctgttattctggcctcaaggccatatcagaacgatgcccttgtgaaccatgaccttccggaaatgtttacaagtctcggcattccggtgctgacggcagattctctggaagaagccgaccatgtggatttaagcatgagccgactggatattgtcaataattatcatgcccgcatgctgtccactgctattctggctgccagaaatccacatctggaatatgtgcagattgtcagcttcggctgcggacatgacgcttacctttccgatgaaatcattcgcctgatgaaggaaatttccggcaagacaccgctggttctgaaactggacgaaagtgatatccagggtccgctgcgtatccgtgtccgttcttttacggaaacggtcagcatgaaccatgccattcatccggaactggatattcacccgttggaagacccttacccggtgaaattcaccaaagaagactgccgcaaaaagattgtccttgttccgaatacctcccatgctttctgtcgaattatgtcagccgccatgcgaggacagcatattcaggcagaaccactggaaatcggccgtgaagaagccatccgccttggcaaacagtatgtccacaacgacatctgtttcccttgtcagattgtgatcggtgaagcactggctgcattaaagagcggcaaatacgacggcaaagaagtggccatcggtatgggcaaatatatcggcgactgtcgtctgacccattacagtgcccttcttcgcaaagcccttgatgacgccggattccatgatgtgccgattctgaccaacgatgatgtagactaccacaatatgcatcccggcttccgaatgagcctgggttccgccatccgtctggcttttgctctgcctgtgattgacgtactggaagaactgctgcgcaaaatccgaccttatgaaaaggtggccggcagcaccaaccgtgctttcgaaaaaggtatggatgccgttgtggaaggccttgagcttcacggtatcagcggtctgaaaaaaggctttaaaaaggctattgacctgatgaaccaggtaaaatatgaccgcaccaaccgtcgtccgcgggtcctgattgtcggtgaatacctgttgaacttccatccaggtgccaatcacgatattgaaaattatctggaacataacggcttcgaaatcattgaagcccacatgacagacgtcatccagaaatcctatttctatctggatgcgcagattaaagaatataaattaaagaaacctttaaacaaaaaaatctggttttcgacagtagacactgttttcgacatggcccacaatatggcagatgctatcgccaaaaagcatcccctctatacaccggcctgccgaatgcctgaccttgtcaaagccagcgacccgatcatcaatcatacatttgatgccggcgaaggcgtcctgattccgggagaaatcctgcaccatgccaaagacggctgccgttcctttgtcatccttcagccatttggctgcctgccaaaccatgttgtaggccgaggcatcagcaaacgcctgaaagaaatgtacccggatgcacagatcctgccattggactatgatccggatgtcagctttgccaacatcgaaaaccgactgcaaatgctgattatgaacgcaaaaagcgggaatattaaggataaaaattaa

SEQ ID NO: 3233 - DNA, 2127 bp, Coprococcus catus
atgattgttatcaaaagggatggacaggaagtcaattataaccgcagtaagattatagttgctatcgggaaagccaatgaggaggttccggaagaagagagaatctcgaatcaggagattgaagagattgtttcttatgtggagactagaaagagaaagagaattcttgttgaagacattcaggatatcatcgagcagaaattgatggccttagggaagtttgatttggcgaagcgatatattgtgtatcgttatacacgtgagttggtgcgccgcgccaatacaacagatgattcgattttgagcttgattaagaacagcaataaagaggttatggaagagaattccaacaagaatgcgacagcagcttccactcaaagagatttgatcgcaggcgaagtttccaaggatctcacgaaacgactgcttttgcctgagaagattgcaaaggcccatgaagagggaattctgcatttccatgatgcggattattttgtacagccgattttcaactgctgtctgatcaatattcaggatatgttggacaatggtaccgttatgaacggcaagctcattgagagtcctaagagtttccaggtagcctgtacggtgatgactcagatcatttcagcagtagccagcagtcagtatggtggacagtctgttgatctgaagcaccttggcaagtatctgcgcaagagccatgataagtatgaaaaggcctatagagcacattttggcgatgaatttgatgatgataccattgagaaacttgtccaggatcgtctgaaggatgagctgaagtccggtgttcagacgattcagtatcagattaatacattgatgactaccaatggtcagtcaccttttgttacactctttctgaatctggatgagaataacgaatacattgaagagaatgcaatgattgttgaggaaatcctcagacagcgtcttgaaggtattaagaatgagaagggtgtttatgtaacacctgcatttccaaagttgatttatgttctggatgagaacaactgcttaaagggtggcaaatatgattacattacgaagctggctgtgaaatgttctgcaaagcgtatgtatccggattatatttctgcgaagaagatgcgtgagaattatgaaggcaatgttttcagctgtatgggatgccgaagtttcctgtcaccttggaaggatgagaacggcaactataagtttgaaggtcgatttaatcagggtgttgtcagcattaatctgccgcagatcggtattctggcgaaagggaatgaagaagtattctggaaactgatggacgaacgtcttcagttatgttttgaggcgcttatgtgccgtcacaatgcgttgaagggtacattatcggatgtcagtcctattcactggcagtacggtgcgattgcccgtctgaataagggtgagaagattgatccgcttctgtatggcggttattctaccatgtctcttggctatatcggactctatgaagtaaccaagctgatgaagggtgtcagtcatacggatcctgtgggcgaggagtttgcacttcgtgtcatgaatcatatgaaggaagcagcagacagatggcgtgatgagacgaacatcggtttcagtctatatggtacaccggcagaatctctttgctatcgttttgcaagaatcgatcttgagaagttcggtgagattaaagatatcactgataagggatattatacgaattcttatcatgtggatgtcagagagaagattgatgcattcagcaagttctcatttgagagccagttccagaagatttcatccggcggatctatttcttatgtggagattccgaacatgagacataatcttgaggcattagaggaagttgtcaagtttatctatgacaatattcagtatgcagaatttaatacaaagtctgattattgtcatgtctgtggttatgatggcgagatcaagatcaacgatgatcttgagtgggaatgtccgcaatgcggcaataaggatcactctaagatgaatgttacaagacgtacatgcggttatcttggcgagaatttctggaatgtgggtaagacgaaagagattaatgccagagtgatgcatttgtaa

SEQ ID NO: 3234 - DNA, 2532 bp, Coprococcus catus
atgagcagaactaagaagatactattgacgctcctagcctatcttaccgcttttattgcagcagtctgtgtcagcagctttgtgcttaatcagggaaaggtcagcggtgagcagcagcgttcaagcgcggatctgccgcttttgtatgtgcgtaccggcggtgaactcatgaatgaaatgcatgggtacacagagccggtagacggcggttactacagagatacgctgacacctgtaggtgagagcaagaccatcaatctgagtatggatacctatggacacaacatttcctctgtcagttttgagctgtacaatgatcagtatacagatctgatcgaaagcggagactgtaccgacatggaaaaggtcaatgctatggttcagatgcagctccaattcaaaaacacactgtattccaacagggagtattgtctgcatctgatgctgaaaaacgatcaggatcaggtttatcattattatacaagagtccgttacggatcggatctgaaggtagctgagaaactcaagtttgtcctggatttcaatgaaacgactttcaataaggacagtgcagatgctttgagcagttatcttgaatcaacatcctcttcctcgagttcagacaagagtctggtgacgctgtattcatcgtcggatacggtgacatggggaagtatggcgccataccgaacaagcgagatcgctattcgtctgaaggagattaatacggagacggcggcttttactttgtcctatacgatagaatcttcagccggagatattaatacattttataatgtcaatgagtattacaggctgcgatggacagattcaaaggtctatcttctggattttgaacggcggatggcagagaatatcggactggcagatataactgtttcttcaggagcactcaggcttggtatcggagacgcttcagatatcgactatgcctcctatggaacagaccagcagcagtatacctgggtaacaggcgatcagcagctgtggctttatgacaataccaaccgtattatgaccaaggtttatacggaggaggatgacaatcacaattgcggacgacaggatgaagccggcataaaggttgttcatgcggatcctgaaaccggagatttgtattttattgtgtatggttatatgcattccggtaattacgaaggccgggaaggcgtgatggtttatcatttcagccatgaagatgttcttctggaagatcttgtttttattccttttaataaaggttttgagcagatgcggtcaggcctggaggaactggcttatatgaatgatgacggcacactgtatcttttgctggaagataccgtttatgccatcgatgtcaatatgggcaaaatggatgtggcctacaaagacctcaacagcagcaattgtacagcatcgggagacggcatttttgttatgtgtgacggtggtgatgaaaatgccggagaacggctgaagatcgttgatctgaattccggaaaggaaagaaccattgaaggcggcgactggcggattgttcctcttggctatgcgggaaaggatctgatctatggtctgatcgatccacagatgttgacagaggattcctccggtgtcattcgcacaccgatcagcgaagtgcacattttggatgagaattataatgaggtcaagacgtatcagaagagcggtgactatgtgatgcggctgaccatcagtgacggcaatatatccatgaagctggccaaggctgtaaagaacggcaattatacggattatcaggatgctggtgaagattatatcatccgtaatatcgaaaatgatgaccagaaaatttatgtggataaacaaaaggacagtatcagaggacagcagaactggctgcatctgaatacatccgacagttttgtgccgatttcacagagtgcccgttacctggatccgggttatgatatttcaaggaaatacgaagatacggatcaggtggaaatgcagtattatgtttatacaaagggacgcatggatgcggcatttgcgacgatccaggaggctgtggattacggtacgacctacgccggcacgattatgaccagccacaagcaggtgatctggcagaaagccggaagagcttatatctgggatctgaatattgacagtattgacaagaccagcaatacacagagcatgaacagcattttgatcaagacgattgcagattacgaaggttgggaattaaatggcacaatcgatgatgcagagccgttatttgcggcgatgacagcagtacttccggcggagacgattgatctgagcggcctgaagctggatgatgtgcttcattttgtttatcgcgaccgtgttgtggctgtcaaactttcaaacaacaattacggtctgatcacggcttatgataatgattatgtctggattgcggatcctgcaaagggagaagtatattccatgacacagacagcagcagaaaagctttttgagcagaatggaaaagtctactatagctatatggattaa

SEQ ID NO: 3235 - DNA, 3249 bp, Coprococcus catus
atgaagccgattcagctgacaatgcaggcctttgggtcatatgggaagaagacggtgattgattttacaaaaccggatcagaatttatttctgataacgggcgatacaggttccgggaagacgacaatttttgacgctattgtttttgcactttacggagaagccagttctgttgtgaataggaagaacggtgccgaattacagagtcagtttgcagcggcatctgtggagccttttgtggaattggttttttcagaaaaagaaggcagtgaagatgtgcactatacggttcgacgtgtaccgaagcatgtccgccctctgaaaagaggaaccggtctgaaggaagagagcggcagtgtgtcgctgattatgtcagacggaaccgaatatccgtcaaaggaaacagacaggaagctggaagaaattgtcggattgacgaagaaccagtttatgcaggtggcaatgattgctcagggggagtttatggcccttttgcgcgcaaaatccgatgacaagaaagtgattttcagaaaactttttaatacagaactttaccagaatattgtggatgagctggcaaagcgccgtaaggacaaggacaggaaaatcgcacagatcaagacagcctgtcagacagaagtgggacatattcttgtgccgaaactggtgacagcggatggtgcagagacggatcaggaacagaatggtgcagcggatcaaatagcggacgagtgtagagatgcgaataaactgcaggagttaaaagaaagaatccttaaatcagaaaggctttcattgccggatatggaggctttacttcagactttggtatcagtcagtgaatggacgaaggataaggtgcagcagtcagagtcagagacaagccaattgtataaagtctatctgttgaaaagagatgctgtcacaaaagcagggcagttgctggaacgttacaaggagcttgaggatgctgaaaaggaactgggtgaatgtgaagcaataaagcctttgatgcaggaatggcagcaatgcatgtggcagattgaggatgcctatgatattttgccgctttggaagcaatatcaggaggtcagtggacagcttgaaacagcccgacaggcactcgctgccaatgagcaggcactgccggaacagaaaatggcctgtgaacaggcggcagttcaactgcagcaggcaaagaaagtacaggaacaggcattgatggatttctcggaagtgaaaacccatgtcgaaaatgatttagaagctttttccaaaatggctgaagctaaacggaaggtgttgacggctcaaacaaaagtcgatgaagcaggaaagcaggccagaatagcagaggaaagtctgtcagatcttgaaagtaatgagaaacagtggcagactcaggctgaactgctgtccgatacggatagccgcatgattattttacaaggaaagcagcgggatattgcaggtatcggggcggattttgagagctggaaggatgaagaaaaggattgcttcagccaacagaggtgtgctgaagaagcagacaaggtctatgctgatgctaaagacagatttaataaggagaatacggcttacatacaggcctataatgatttccttgatgcgcaggctggtttccttgcagagaaactgcagcggggagaaccttgcccggtctgtggttcgaccatacatccgcatcctcatcaggcagaaaaatcggcattgaccaaggaagaattgaatatattgtctgagagtgtacgtgaacttcaagaaggacaggcggcggcagcgaaaaaagccggagaggcaaaagcaatgctggatgcaaaggaaaaaaattgcatacaaatttgggaaaaacttcggcagaaagtaattgcatatagccgtgatgagatgggtgagttggacagtgaagagattcaaggtctgattgagacttggaagaaagcgctgaaagatgaagagaaacagctgcagaaagacaaaaatcagctgcagcagctcaaaaaatggctgacgaaagctgccaaggacaaagaagaattgactgcacaaaaaaataaagcagataaaatgttagctgataccaaagccgagctggcggcagctcaggctgagttaaagagtacatttatttctacatattataaatctgaagaagaagccaatcagttcatggagcaggccgagcaaaggaagaagaacgcagaaaagcaatatcatagctgtgataaagttgataaaaaagtacgatcagataaagaaaagacagagctagaaatagcacagcatcgacgcgatattccgaatttgcaggataagagtgataaacgaaaagcagtctatatacagctgatggaggaaaaacagctgacggagcctcaatggaagtgtgtgacagaaagttatgataaggcagacagacagcagtttgaagaaaaaatcagacaatatcagagtaagctgagtgcagcaggtaagcagaaggcagtagcagagaaagccattgacggccgtgtgaagccggatatggaacagctttgttctgaacgaaatgtagcagaagcggcatggaaaaaagaacaggctctttatgagcgctatgcagaaatgtataaaaccaatcatcgggtttgtgaagcgttgatgccgaagatggctgaacgaagcaaaatcatggaagaacacagaagactggatgatttgtacaatttgttagcaggcaaagtgacgggagccagaatggatatcgagacgtatgtgcagcgatattaccttgagagaattctgtatgccgccaataggcgtttcggtgaaatgtctgccgggcagtttgaactgcggatgtgtgatatcacgaaggcgggtgaaggaagaaacaggggactggatttgatggtttattccaacgtcaccggcaaggagagggaggttcgcactctttccggcggagagtcgtttatggcggcattgtcactggcgcttggcatggcagatcagatccagcagagttcatcggccattcatctggatatgatgtttattgacgaaggattcggctcattggacagccaatcaagagatcaggcagttcgggtattgcagcagatggcaggaggatcgaagctgataggtattatttcacatgtgtctgagctgaaacaggaaatagaagaccaactgattgtcagcaaagatgaagagggtagttcagccagatggcagatcagctga

SEQ ID NO: 3236 - DNA, 2628 bp, Coprococcus catus
atgaagaatagaatatcaaaaaagagacataacagttacagaaagagggagagaaatttcagagattggccaaagaatccgcatttttacggtgcgctggcgatgcttctgccgttgacggcgatactgatcgcttatattgccatgggcgttttccctttcggcaatcaggcaacgatgatcattgactcttatcatcagtatgtaccgtttttctctgaatttcatgataagatctggcatggtgaaagtttcctttattcatggcacggcagtctgggatttaattttatagcggttcaggcttattatctggcaagtccgctgaattttctgattgccttgttcccggcctcgatgatgatagaggcctttgagacgctgatcgtgctgaagatctgtctgtcaggatggacggcttatcgctatctgcggagaagaaccggaagaaatgattattcgacggttgtgtttgcatcgttttatgcccttggtggattcagcatcgcttataactggaatgtgatgtggctagacagcattgtcctgtttccgatcattcttatgggtgttgagaagctgatcaatgacagagacggtcggatgtatgcagtcagtatgggacttgctattttctgcaattactatatggccattatgatctgcatttttgttgttttgtacttttttgttatctggttttccagaaagcgagaaggcatcagacagtttctcagaagcggtattcattttgtgctgtgctctgtgttggcgggcggaatggcggccatttatctttttccgacgtattatacattgatcaacagttcccagggatcggccccgacaagctttaagatctacaggaatttcctggagatttttcgtcagcagtttgcactggttgaaccgacgcagctgacaggggcgccgaatatatactgtggcgttctgcttgtgatgctggttgttttttatgcggtttccaaaacgattccattaagggaaaagatcggacgtctttttgtaacaggatttgttctggtgagtctgaatattaatgtgcttgattatgtatggcacggattccatttcccgaataacctgcccggcagattctcttttatttatattttcatggtggttgttatggcctacgatgcatggcagtcactgcggctgacgaataagaaggttttccttgggatttttgcggcagaagcggtgctatttggtgtatgtctctggtatccgaaggatcgtctgcccctttacagtatgattgtgacaggggtgctgatggcactttacatgatcctgctgatcgcccatcggagacatgcttcattgacgattaaaggcattaaggtcctgccaaagtatctgtgtctgatggtactgacagtggaagtggcgggcaatgctatttttggcctgtgtatgaacggaaccaccaaccggacgaactatacagaggacaggcaggaggttgcagatatccgcagccgctacgaggcaaaagatactttttacagaatggaactggaacagatcagaggcagggatgatgtcacatggcatcatctgaatggtctttcattcttctcatcaacagcggatgatcgtgaggagaagttgatgggagctctcggtttttacaacagcggcaataaatacagctataaaggggcaacgcctctgacagatgcgatgtttggtatccgttatattatcagcaatgatgaaatatgggcgtcgaatctgtcattatgtgagcagacagagaataagtatatttatgagaaccaacagaatcttgctcttggttacatggtgaatccgggggttacccagtggaagatcgtggaaggggatccttttgtcacccagaatgattttgtgagaatggcaacggatactcagggagcgatgtttatcccgcttgaaacgggagagccgcaggtgacagatggcatgttgaccagtaccggtgaggataaatattattatgagcggcatggcagcggcggaagcctgacctggcagctgactttcacggagcagcaggatgtgtatatttattttgaggccagtcattgtgagaagctgaaggtgacgattgacggaaagacggagacctattctgataagcggggacatattgtgcatcttgggcagtgtgatgcagggaaggttgtgacattggattttccgatggacagcgaatatgaaacaggcaacgtgaaactgcagatgtatgccctcaatcaggatattttcgattcggcctatgcccagctggcggatgaacagctgcaggtgacaaattacgacagcacccacgtcaatggacgtattcaggtgaatcaggatggtatgatgctgctgtcgattccttatgacgaaggctggcatatctatgtggatggtgaagaaacagagatacagccggtgggtgaagcgatgacaggatgctggatgacagcaggcgaacatcagattacgatgcggtacacaccacagggatttgtggaaggagccgcgatcagtgttatttcactactgatacttgtgttgggaattgctggaaaagcaggtcttttcagcagacatcataggaaaatgtaa

SEQ ID NO: 3237 - DNA, 2610 bp, Coprococcus catus
atggcattttactccgcgttatttcaaattctgcttttgaaaggaaatataaccatgactgattttttatatcctgatattttgaatgaacaactgacctatgccagacaggcacgtgccgcatggctttggaccaatgttgccgaacgaagccggatttttctgcaagttctggatacccttcagcccatctgcgcatcccttgcccgtgacagcgtccaagagacgggctacggtatttttgaggacaggatgctcatgatcacacgcctgcttcgtgacctccgttcctgctgccttcaaacagaatctcccttttcagaacgtctttcctgcacggacacacacacccaaagccagccctccggcactttgcttggcataccatcatccatacatccggtcactgaaaccctctttgccgctgctattgccattcaaacaggaaatccgctcatttttttcttttctgacagtgcatttcagatatcggcccgaacagcctccctggtccgtgatgctgcaattgctgccggtgcacctgacaactgcattcaatggctggaaattgctgatgacaacctgcttgaaaaatgcaatcactgtcccgacatcagcggccttattctttccggactttccgccaatatccgcaaagtattttctgctttttcagcggaatgtatcctttcctttccacagcctgctttctgctatatccactacagtgctgatccgacacttgctgcagggcagattgttttatccaaaacctttgacaacggaatgtgcttgaacggtgagcagataatctgtgccgatgctgtgatcctgccgtcgctgaaagatgccctgcgccgcaccggcggttattttgcatccccggaagaaattgtccgcctcactgcgattcttgccaacctttcggacaatacagttaatccttctgttatcggacaatctgcgcaggcactggctgatctggccggtattgtcattcctgaagccacccgcctcattattcttgaaatcgaaccggataatgcttcccacccacttcttgtgccctttttgtgcccggttcttgtactgatatcggtgaatgattatgaacaggcagccgacaaaattcgtcttttatccacaaaaagtgcatctttttccactgacttccctttttccgacacccgccccctgccggcacatcattatcttgcgctttatgccgccgacaatgcaccgatttcatttttatcctatgcacttccggatttttccataattgaaaatgctccggctgcttctgtatccatgatccagcaatatatggatatctatggccatcttcttccttcttcagccattcctcagcttttttccatccgccgctgccattcgacaatgatcgaaaacgcccgctgcttttcttttcctgcagaaatttattatggacaaaatccccttgaacaactgaaactttatgaacatgaagaccatcttctctttctgcagtgtcctgcattttcagaatctgccgttcagactgtcataaaaaggatacagcaaaaatacccctttattcagtatgaatgcctaaagcttacgcccgatgattcacagatcaccgactttctctgccagcactcgctttttcctgaactgcctgctgcaccggattgtctcattgtcatcggtgacagcaccgctgtccatattgccaaaatgctcatgacccgttatcagcaatccgcaagttcttccctcccacgcctgatcatcatgacttcggatgccggatgccatgcggcgcttctgcctttttatccacactatgacagctgcagcaaccgattgacagatatgtcctgccagctttcccattttacattgattgctgacagccatttttccttttttcgaagccacaaacatctgatcagtgcctgcatggctgctatggccgatgcttttgattctctcttattcgtcggcggagatgatatttccgatgctatggctttccgttccattcagctgtttcttgtctggcttccgctttttttgtccgccccctccgaaagagggcatcaaaaaaacaggcctgacgcctgtttggaacatttgcaaaatgcatgtattttatccggactggcctgttctcataccggcctcggcctttctcatatcctctcacaacaattatgctgtgaatttcggatatcgatgtctgccttgcaggcactcctgataccccgtctgctcctgtattatggcagtgattccacacatctctccggaaaagcctggacggtttctgcctccgcctgctctgctgataactatttaaaaatgctggctgccatcaatccatccttcgacggaaaccgacgggcagccgatatactggccgaaaaaattgacacacttcttgatgatgcccatctcccgaccaatattaagagctgccatatccgagaaaaagactatcttcagcgcatagaggacctggctctgcgcagttttgaacagttatccgccatctgtgccgatgccggatccggatatccgctggtcagtgaaattgtccggattctaaaagatatctattag

SEQ ID NO: 3238 - DNA, 2691 bp, Coprococcus catus
atggttgtttgggcgtcagatggaatcgaaggagaacggatggatacagaagatacagagacagaaagggtgattcgggaaagtgaggacagggaaagtcagatccaggaagaatctgaaggcatagccggtgaaacatttacggaaaacgatgtggaaacagaaacagggattgaagattcctatgtgtatgatggagaagttttctcggaagtgaatgaatacagcgcacgtgcagtgacaaaaggtaaaattgattatacatattgggcgattcatcagggagcaggttttggaaatattcttgaggatggacgtgacctggatcatgtcggctgtattatgctgaaggtgggaaatacctggaaaacggcttactgtgtccatcataatgctgatttgaagggtggccatgaatatgcggatacagcgtcatatttgacagattcgaataaaaagagactgacaggtctggctttatattatggttttcgtttttctggttggaatccggataaaaaaactgttccgggggatagcgataaaggaaaatatacagcaacgcaggtgatgatatggatgattgaaagaggctggtatacgtatgatgcgaatacatatgcttttcaattgaatacaaaggcaatcaatgcagcaaagaaaatctgtgataaatcggatcagagccctgtcggaagttcctatgactattttaaaacgatatatagtaaaatgcagacatttggtacagtgccgtcttttacttatcggagtgagaacagtgcgcaggtcaggaatatggggtatgactttcaaacaaaccaatatgttctcaaactgacggatacgaataacgttttgtccatgtatgatgtcagtgaagtgccgaagggtgtaacagcccaaaagacgggaaatacacttaatttatattcatcagtaccaatcacatctgcgggtgtgataaagttgtcaaagaaatccttcaaagcggagaaagctgtgactgtgtggtcagaccagacaataagcggttatcagcaaattggaacttacaaagagccggaaacggcagatttgaatacctatctgaagataacagcgcagtctgtaacgatgacggctgaaaaagtatggaatgacagtgataatatttatgggaaaaggccatcagaattgatggtagatttgtatcgaggccaaagtaaaggggataaagctgtgcttgtaaaaacggtcatattaaatgcggaaaatgaatggcagtttacagtttcagatcttccgcagaaagattccgcaggcggacatatttattatatgtttacagagcgagaggcagcgggttatacagcggagacaacagagagtacagccgggacgcgtcattggaagtttacgttcaccaatacattaaatagcggtcatctgcagctgcttaagaagtcatctgatgaggcacttacaggtgggaatccctgttatacactgttaaatgcagaatatggggtttatacagatagaaactgtaccaatagtgtgggtgatctgatcacgggtgaaagtggatggtccaatacactgacatcacttgctgcgggaacatactatgtcaaagagagaaagaagccttccgggtatagaacagatgatgctgttcatgaagtaatgataaatgagggggagacaaccgtgataacattgacagatgagccaatcatcagctggggacagtttcgaattgaaaaatcagcattggatggtgcatcagtatctgatacaattccattaacaggagcggaatttaccattgattattacagagaaacaggggtaacaaaggaaaacatttccgataaggtaccattaaagacctgggttgttgctgtgaaaaaaacatttgatggtcagaacacttcgtataaggcggaattagaggatacatatctgattgcagaaaagagtgacgaacttttcagggataggatggggaaggcggtactgcctcttggaacaattgcaattcgagaaacaaaggcagcagaaggctatttgctgcaggggtatgtcgatgatgctgatggaagacggctgaacaattaccctggggaatcagttatcatcaacctggcagatgaaggtgaaagtgcatcgttttttggagaagacggattgaaatacagtaatcctgttttcagggtgacaaatgaattgcataaatgtagtatacagattatgaaatcctcagcagatgaaaagccgttggagaatgtgagatttggtctgtacgatgaaaggcgacagaaaatcctggaaagtcagacgagtcaagatggtaggataatattttcggggctgcttccggggaaatactggttaaaggaagaaaaaacaggaaacggacagcagctgctgaaagaaccaatggaaatcgtgctgccgatggtattaacagagcaggacgttgaaaaactaaaaattgataaaagtcagctggtctatgatgaaaatcagcaggtatttaaattgtatgacagaatttttgagatatcaaatgcaggaaatttagtattaccgatgacaggcggtgatggattggtcttacctgacattctgtttttggcagccgctctgctgctgatcggcgtctgcttgtttgtatatcgtaaggggaaaacaactgcccgatga

SEQ ID NO: 3239 - DNA, 2853 bp, Coprococcus catus
atgagtaaaacagtattaggtattcttgcacatgtggatgcgggaaagacaacgttatctgagagcattctttatctgacaggcagtatcagaaagctgggcagagtagataacaaagatgcttttctggatacttacagcctggagagggagagaggcatcactattttctcaaagcaggccgaaattgagatgcggggaagatcgtatacactgcttgacacaccgggacatgtggatttttcggcagagatggagcgaacgcttcaggtgcttgactatgcggtgctggtgatcagcggtgcagacggtgttcagggacatacacagacactgtggcgtcttctggcacggtatgaggtgcctacatttatttttgtgaataaaatggaccagaatgggacagacagaagggctttgatggaggagatcagacagcgcctgggggacagttgcattgatttttccgaagaagcagatgcacgcaatgagaatctggcgatgtgcgatgagaaggtgctggaaacttatctggaaaagggaactgtgacggatgaacaggtgtgcagaatggtcaccgggagaaaggtttttccgtgcttcttcggttcagccctgaaattgacaggggtgcaggagttgttggacggcattgcaaaatggacagaagagaaacagtatccggagacattcggggccagagtatttaaaatcgcaagggatgcccagggcggacgcctgacttatatgaagattaccggtggcagcctgaaggtcaaggcacagctccggggccatatacggagaagacaggaagccgggggtgaggcagaggatacattatccgggaaagatgcttcggcaggtgaatgggaagaaaaggttaatcagatccgtatatataatggaacaaagtttgagacagttgatgcagtttcagcaggtacggtttgtgcagtgacagggcttacacagacacaggccggagacggactgggagcggaggctgagcaggtagtgccccttttggaacctgtactgacttacagggttgaactgccggagggcagtgatctgcacaaggtactgcatcaattgcgtcagttggaagaagaagagccggaactgcatattgtctgggatgatatttcaggacaggtgcttgtgcagctgatgggtgagatccagacagaaatattgcagcagatgatccatgagcggtttggactggaagtaaaatttggtacaggacagattgtgtataaggaaacgattgcagcaccggtggaaggtgtgggtcactttgaacctctcagacactatgcggaagtccaccttttaatggaacctttggaggccggcagcggacttgtcttcgatactgtctgcagcgagaatatgttggatcgcaactggcagcgtctgatcctgacacatctggaggaaaaggttcacagaggcgtattgacgggagcgccgatcacggatatgcgcatcacattgattgcgggaagagcacatcagaagcataccgaaggcggggatttcaggcaggcgacttacagagcggtgcgccagggactgcagaaagcagaaagtgttctgctggaaccttattaccgcttcaggctggaattgccgcagcgtctggtaggacatgccatgacagatattgagaagatgagtggcaggtttgaacttggagaaaatgagggcgaaacagccgtattaacaggaatggcacccgtttcagaaatgcgtgaatatcagaaggatgtggctgcctataccggaggcacaggacgattgttctgtacaatggcgggctattatccttgccataatacggaagaagtactggtggcatcagcctatgatccagagcgggatctggcaaatccgacggggtctgtgttctgtgcccatggtgcaggatttgtagtgccatggtatgaagtggaagattatatgcatctggaaggcgccggactggatggagagacggcaggtgctgaggatgaggatacggtggtgacagcaaaagcgaaggctgccagaagccgaaacattgcaccgtctctggcggatgataaagaactggaagctatttttgtcagaacatatggtgaaattaagcgacgaaagccacagaaagaacgtacattcagaggagcggatacaagttattcagaagtatcaggctcttcagggaaaatgacaggtgggttgagtgattcatccggtaaaggcagctggcgaggcgaaaagaagcagcaggagaacagacggcaggcgaccgcacaggaaagctatctgcttgtggacggttataatatcatttttgcctgggaagatctgcatgaattgtcggaacatagtatggacgctgcacgcaacaagttgatggagacattgtccaactatcagggctatacaagccagagggtgattcttgtttttgatgcctataaagtggagggatttccgggtgaagtgacaaagtggcataatattgatgtcgtttttacaaaggaggcagagacggcagatcagtatatcgaaaagacggcccatgccatcggaagaaagtataaagtaaccgtggcaacatcagatggccttgagcaggtgattatccgaagtcaggggtgccttttgatgtcagccagagaattgcggcaggaaatcgagaggataaaagtcgaaatccgccgtgagcatctggagaagaatcaggagagaggcaattatctgctgaattatcttccggaagaagaggccgggcggatggaagccatccgtcagggcctgatatcagcagatgaagcggatgcggacaaaaggcgccgctga

SEQ ID NO: 3240 - DNA, 3471 bp, Coprococcus catus
atggattttacacatttgcacgttcatacagaatacagtctgttggatggctccaataaaatcaaagaactgatcgccagagtcaaggaacttggcatggacagtgtggccatcacagatcacggtgttatgtatggtgtgattgatttttataaggaagcacagaagcagggcattcatccggtcatcggctgtgaggtttatgtggcaccgggttcacgttttgacaaaagcggcaatatgagcagcaacagatatcaccatctggtattgcttgcggagaatgataccggttatcataatctgatgaaaattgtatccaaaggttttacggaaggcttttattataagccccgtgtagataaagaacttttaaaagaatatcatgaaggcatcattgctctcagtgcctgcctggcaggagagattccagatgcattgagaaaaggcctgtatcaaacggctttgaatgcagcacaggaaatgtcagaaatcttcggtgaagatcatttttatctggaattgcaggatcatggcattccggatcagaaaacggtgaatcagggattgcttcggctggcgaaagatacaggccttgaattggtagcaaccaatgatattcattacacattggccgaagatgctcaggcgcatgacgtattgctgtgcatccagacaggcaagaaagtggcggatacggatagaatgcgttatgagggcggtcagtattatgtcaaatcaccggaagagatggcatcgctgttcccttatgcccgtgaggctatcgagaatacgcacaaaattgccatgcgatgccatgtggatatcgagttcggtcattacaaactgccggaatttcctgtgccggaagggtacgattcatgggaatatctgcagaaacttgtctgggacggtttttatgaaagatacccgcaggcggatgagaagctcaaagagcgtgtcagctatgaattaaataccatcaaaaccatgggattcgtggattatttcctgattgtatgggattttattcattatgccaaagagcatgacattatggtcggaccgggccgaggttcggcagcaggaagcattgtatcctactgtctggatattacaaccctggatccgattcgctacaatttactctttgagcgattcctgaatccgaaccgtgtgacgatgcccgatatcgacgtggatttctgttttgaaagacgacaggaagtcattgattatgttgtcagaaaatatggcaaagagcgcgtggtgcagattgttacatttggtacaatggcagcgcggggtgtgatccgtgatgtggggcgtgtcctggatctgccttatgccatctgtgatagtgtggccaagatgattccgaatgagcttggtattaccatcgataaggcgctgaagatgaatccggagctgaaaaagctctatgacggggatgacagtatccacaatttgattgatatggcaagaagactggaaggcctgccgcggcatacatccatgcatgctgccggtgttgttatcagcccgaaggctgtcgatgagtttgtaccgctgtcgagaggcgcagacgatgtgatcacgacacaatacaccatgaccacgctggaagagctgggactgctgaaaatggactttctggggctgcgtacactgactgttattcggaatgcagtgaagctgatcaatgcagacggtcggcatcatgtggacatgcatgagattgattacaatgacaaggctgtttttgatatgatcggaacaggaaaaaccgacggtatttttcagcttgaaagttcaggaatgaagagcttcatgaaggaactgaaaccccataatctcgaggatatcattgcaggtatttcgctttatcgtccagggccaatggattttattccgcgttatatcaagggaaagaacgaaccggcgtccatcacgtatgagtgtcctcagctggaagagattctggaaccgacctatggctgtattgtctatcaggaacaggtcatgcagattgttatgaaactggccggttatgatctgggacgaagcgaccttgtgcgtcgagctatgtcgaagaaaaaagcggatgtgatggcgaaggaacgccagtactttgtgtacggcaatgatgaactgggtgtgcccggctgtattgccaacggtattgatgaggcgacggccaacaggatctttgatgagatgacggattttgccaagtatgccttcaataagtcccatgcagcagcctataccattgtttcttatcagacagcatggctgaaatactactatccggtagagttcatggcggctctgatgacatctgtcatcgacaattcagtgaaagttgcagaatatattatgacctgcagacagatgggcattaagatactgccgccggatattaatcatggcgtcagcagtttctctgtggacaacggcagaatcctttacgggctttctgcggtcaaaagtatcggaagaccggtggtggcagccattgaacaggagagaaccctggcgggaccatttacaagcctgaagaatttcattgagcgtatgagcggcaaggaagtcaataaacgttccattgagaattttatcaaggcaggtgcctttgacagctttggagccacaaggcggcagcagatgatggtttatgcgcagattatggatcaggtggctcaggacagaaagaaaaatatcagcggtcagatgacattattcgatttcatggacgaagaagaaaaacaggcttttgagattcgttatccgaatgtgggtgagtatgacaaaggcaccctcctttcctttgagaaggaagtcctcggggtatatatcagcggacatcctctggatgatgtggctgagagttggcgcagaaatgtcacggcggtgacctccgatttctatgtcaatgaggaaagcggtatgccgaatgtggtcgatcagtcattggtggtcattggcggtatggtgacgggcaaaacagttaaatcaacaaagaacaataagatgatggcttttattcagttggaggatctgctgggaacagtagaagtcattatttttccgaatgattatgagaaataccaggctgagctgacagaggaggcgaagctctacatcaagggccgtgtgtctgcttcggaggatcagcaggcgaaactgatcgcggagaagatcattccttttgataaggtgccaaaggaagtatggttgcagtatccggacaagaacagctttatcggacagcaggaaaccctgtacaaaaccctggcggggcattcgggtaatgaccgggtcatcatattctgtaaagtggaaaaagccattaagaaactgcctgtatcatggaatataaaggcagaggaagaaattcttgaccagcttggaacagtattgggaaaagaaaacgtaaaagttcgggaaactgtcttgaaaagcttctaa

SEQ ID NO: 3241 - DNA, 2571 bp, Coprococcus catus
atgcagcaatttattgtgacaggtatgagctgtgcagcctgcagtgcccgtgtggagaaagctgtctcgaaggtggagggggttacctcctgttcagtcagtcttttgactaattccatgggtgtggaagggacggcagctgatcaggcgattattcaggcagtggaagcggccggttatggagcctccgtgaagggtgaggctgcagagcattcaggggcttcatcgatggcagctgaggaggagatgctgaaggatcatgacacaccggttctgaagcggagacttctggcgtcgctgggatttttgattgtactgatgtatttttccatgggacacatgatgtggggatggccgctgccggcattttttgagaacaaccatatagccatggggcttgttcagctgctgttgacagggattgtcatggtcatcaatcagaagtttttcatcagtggttttacaagtcttgcgcatcgtgccccgaatatggatacgctggtggctcttggctctacggcggcttttggatacagtacgtatgcgttatttgccatgacagatgctcaggtgaagggcgatatggagatggtcatgcattatatgcatgagttctattttgaatctgcagccatgattttgacactgatcacagtgggcaagatgctggaggcacactcaaagggcaagacaacagatgcactcaaagggctgatgaaactggcttcgaagacagcggttgtggaacggaatggtcaggaagttactgttccgattgagcaggtgaagaaaggagatatattccttgtacgtccgggagagaatgtgccggtggatggtgtgatcctggaaggaaccagtgctttgaatgaggcggctttgacaggtgaaagcattcctgtggacaagaagccgggggatgtcgtatcggctgcaaccttgaatcagtcaggatttatccgctgtgaggccacccgtgtcggtgaagataccacattatcccagattatccagatggtcagtgatgcagcggcgacaaaggcaccgattgccaagattgcagataaggtttcaggtgtttttgtaccggcggtgatcaccattgcggtcattacgatgatcgtgtggctgctggcaggagaaagtgttggttttgctttggcgaggggcatttcggtactggttatcagctgtccgtgtgcccttggtcttgccacaccggtggcgattatggtgggcaatggtatgggtgccaagaatggtatcctctttaagacagctgtttcactggaagagacaggcaaggttcaaattgttgccctggataagacaggtaccatcaccaacggtgaaccggttgttacagatatggttcctgcggagggtgtgacagaagaatcattgcttgcgttggcagccagccttgagaaacgcagcgaacatccgttggcaaaggcaattttgaaatatgtcggagaacagcagctgattgtagaagacgtttctgagtttgaagcacttccgggcaatggactgacagctgtcagaaatggtgtcaaattggccggcggcaattatgcatttatcagaacccagacggaagtgtcagaggatttgctgaaacagtcagaggcattggcggaacaggggaagacaccgatgtttttctcagagaatggcagattggccggtattattgccgttgcagataccatgaaggaagacagcaggcaggctgtcagtgaacttcggaatatgggcatccgggttgtgatgctgaccggcgacaatgagagaacagccagagctatcggcgcacaggccggtgtggatgatgtgattgccggtgtgcttccggatggtaaagagagtgtgatccgaaagttgcagcaatatggcaaggtagcgatggtgggggatggtatcaacgatgcgcctgcactgacaagagctgatatgggtatcgccatcggtgccggtacggatgtggccattgatgctgctgatgtggtgctgatgaagagccggctcagtgatgtggcagccgctgttcgtctgagccgtgcaaccttaagaaatattcatgagaatcttttctgggcatttttctacaacgtgatcggtattccgctggcagcaggtgtgtggatcccgattttcggatggacattaaacccgatgttcggtgcggcggccatgagcttgtccagcttctgtgttgtcaccaatgcactgcgcttgaacctttttaacatgcatgatgcaaaaaaggacaaaaagttgaaaaatcctgctataataaaagaactggtggataacaataaaaccaatcataatcaagaaaataaggagataggaacaatgaagaaaacaatgaaaatcgaaggtatgatgtgtggtcactgtgaagcaactgtcaagaaagcactggaaggccttgatggcgtgacatctgcggaagtcagccatgaagcaggtacagcagtcgtagaactctcagcagacgtagcagatgacgttctgaagaaaacagtcgaagataaagactacaaagtaacagccattaactag

SEQ ID NO: 3242 - DNA, 2976 bp, Coprococcus catus
atggcgggaaagcagagcagtgaagtcaaacgccgtactgcatcgaccagaaaaacaactacaacaaggaaatcatccgccggaaagaagcggaacacatccgggaaatctgccaatacaaaggcatcgcgcatgcaagtcagtgaatatacagaacctgtgggagatgagatcaaattgatcattatccttgcagtttcaattctcatcttactcagcgtgtttggccttggcggaagagtcggagacaaagcagcctatctcttttttggccttttcggatttgttgcttatgcgcttccttttcttctttttatcggcagcgcctttcacatatccaaccgcggcagtcgtcttgcacggattaaattgacagcagccactgttttcctgattatgatcatggcattgatggcactggctgatagttcttttgacggcacagcctctgtactggatggttttctcaattcagctgctgctcacaacggcggcggtctgatcgggttcagtctgagctgggttcttttcaatgcctttggacgtgccggatctaccgttattcttgtatgtctgatgctggtttccggtgtattgattaccggcaaacggatttttatccgcctgggcactttaatcggacatatgatgaccgatatgggacagcacttcaacgcatggcgtgagaaacaggcccgcgaacgtcttgcccgtatggaagcgaaggcagctgaagaagacagcctgcctgaggatgaagcatatgaagatattgatgaagaaaccgtttccatacagcctaagaaaaaggcagccaatatcattatcccgtcaaggaaaaaggaaaatgtcaagtccaaggatcctgcaccggcatcttcatcagaacccgttttgcagacttataccgaagagtcagcttcatccgctgagacagcggtcatttctgacgattccaaacaaccgtcccttgacagttttgatcagggacagtctgtccagccgttgcatattcagattcctgaatttatgaccggacatgtttccggcaaatcttctgtaaaggcaccttctgcttccatatcagatatcatgtccaacctgagccgggatatcccatccgaagcggaatcagaaccggagactgagactgtcgaagacaaaaatccaaaaggcaagccggtcattgccagaactattttgtctcctgatgatctggagttggaaatagaaggattgccggaggaaacaccggttaatacagacgatacatttatcgatatctccaagattctgtccgagattcctgaaacaacaggaaacatcaatacagaagtggcggacatgcaacctgaggacgtttctccggctgcacaggccgaacagcagacagctgtatcaccgacagccgcccgcacttcatccccttcgcatcatacaactgcgaaaggaactgtagaggatacagcttccggttctgatgaaccccttgaaattgtagaagaggagattgaaaaatacgaattcccgccactggatcttcttgatcagggaaaaggcagcggcaatcaacagacagccgcatccctgaaacagactgcgctgaagcttcagcagacatttgaaagttttggtgtaggtgtccaggtaaccaatgtcagctgcggtccggcagttaccagatatgaactccaaccggatcagggtgtgaaagtcagccgtattgtcagtctgtctgatgatatcaagctgaatctggcagttgcagatatccgaattgaggcgccaatcccaggcaaagcagccgtcggtattgaagttccgaatacccacaaggaaatggtgcatctgcgtgatcttcttgagtccgacaagtgtaagcaggcaaagtccaaactggcttttgccgtgggcaaagatatcggcggccagacggttgttgctgatattgaaaagatgccgcatttgctgatcgctggtgcaacgggttccggtaaatccgtctgtatcaatacgatcattatgagcattctcttcagggctgatccgaatgaggtcaagatgatcatgatcgacccgaaagtggtggaattgaatgtttataacggtctcccgcatctgttgatccctgttgttacggatccgaagaaagccgccggttccctgaactgggcagtaaatactatgatggaccgctacaataaatttgccgaaatcggtgccaaagacttgaagagttataatgcccgtgtggagaatctcccatacgaaagtgaacagcacaagaagatgccgcagattatcattatcatcgacgagctggcagacctgatgatggtcgctcaatccgaagttgaagatgccatctgccgactggcccagctggcccgtgcagcaggtattcatctgattattgccacacagcgtccatctgtcaatgttattaccggcctgatcaaagccaacgtaccgtcacgtatcgctttctccgtatcctccggtgtcgattcacgcactattcttgacatgaacggtgctgagaagctgctgggaaacggagacatgctgttctatccacagggcctgcagaaaccggtccgcgttcagggtgcctttgtttctgaaaatgagattgcgcgtgtcactgattttatccgtgcccatctcaccagtcaacctgtatacagtgagacgattaaaaagagcatagagacagctgccatcagcagtccttccggcgcatcaggcagtgacaaagatgtttattttgaagaagccggccgtttcatcattgaaaaagataaggcgtccatcggcatgctgcagcgtgtctacaagattggttttaaccgtgctgcccgtattatggaccagctctgtgaagccggtgttgttgggcctgaaattggcaccaaaccgcgtcagatcaagatgacgatggaggaatttgaaacttatctcaatggcaatcaatag

SEQ ID NO: 3243 - DNA, 2601 bp, Coprococcus catus
atgaatatggatttaaataaatttacacagaagtccctgcaggcagtgcaggattgtcagaaactggcttatcagtacgggaatcagaagattgaacaggaacatctgcttctgagcctgctgacccaggaagacagcctgatcgacagactgctggcgaagatgggaattaatcatgaaggatttaaggtacaggcgacgaagcttgttgagaagcttgtcaaggtatccggcggccaggtttatgtaggtgataacctgaaccgtacactggtacgggctgaggaagaagcgaagcagatggatgatgaatatatctctgttgagcaccttttcctggcattgtttgagacagccgacagtgatatcaagacattattcaggaattttgaagtaacaagagatggtttccttcaggcactttccactgtccgaggtaatcagcgtgtgacaagtgataaccctgaggcaacttatgacagcctgagtaagtatgcagaagatttggtaggcaaggcaagagcccagaagatggatcctgtcattggccgtgatacggagatccgtaacattatccgtatcctttctcgtaagacgaagaacaacccggtactgatcggtgagcctggtgtaggtaagaccgcagttatcgagggcctggcacagcgtatcgtcaagggcgatgtgccggatggcctgaaggacaagaagatttattctctggatatgggcgcactggtagccggtgccaagtacagaggtgaattcgaggaacgtctgaaggctgttcttgctgaggtcaagaagagcgacggcgagattattcttttcatcgatgagctgcatctgatcgttggtgccggcaagacggacggtgccatggatgccagcaatatgctgaagcctatgctggccaggggtgaactccactgtatcggtgcgacaacactggacgagtacagacagtacattgagaaggataaggcgcttgagcgtcgtttccagccggttatggtggatgagccgacggttgaggataccattgccattctccgtggactgaaagagagatatgaagttttccatggtgttaagattacagatggtgcccttgtggcagctgcaacgctttcacatagatacattaccgatcgtttccttccggataaggcgattgaccttgtggatgaagcctgtgcaatgatcaagacagaacttgattctatgccgacagagttggatgagatttcgcgtaagatcatgcagttggagattgaggaagccgctctgaagaaagaggacgacaagctcagtcaggaacggttgcagaacattacccatgagattgccgaactgagagaagatttcaaggttcagaaggctaaatgggacgatgagaagcaggatgttgagaagctgcagagcctgcgtgaacagattgaagacctgaacaagcagattgagttggctcagagaaattatgatctgaacaaggctgctgaacttcagtacggcaagctgcctcagctgaagaaacagctggaagaggaagaggcgcgtgtccatggagaagagaattctattcttcgtgaacgtgtcactgatgaagagatttccagaatcgtgtccagatggacaggtattccggttgcaaagctgacagagagcgagcgtaataagatccttcacctggacgatgaacttcacaaacgtgtcatcggtcaggaagaaggtgtatcgaaggttacagaagcgattatccgttccaaggcaggtatccaggatgagaacagaccgattggttcgttcctgttccttggccctactggtgttggtaagacagaacttgccaaggcactggcagagaatctgtttgatgatgagaacaatatggtgcgtatcgatatgagtgaatacatggagaagttctccgtgtccagactgatcggagcgcctccgggatatgttggttatgaagaaggcggacagctgacagaagcagtcagaagaaaaccttactctgttatccttttcgatgagattgagaaggcccatccggatgttttcaatgtattgctgcagattctggatgatggtcgtgtgaccgattcccagggcagaacggtagactttaagaatacgattctgatcatgacgtcaaacattggttcttcctatctgctggagggcattgacagcgaaggcaatatcagtgatgaagcaagacagaacacgatgaatgatctgaaagcacatttcagaccggaattcctgaaccgtcttgatgagatcattatgttcaagccgttaacgaaggacaacatcagcggtatcattgatatcctgatcggtcgtctgaataagcgtcttgagacaaaggaactgacacttcagctgacaccggctgcaaaggattacatcacagatcatggttatgatccggtttatggtgcacgtccgttgaagcggtatatccagaagaatgtcgagaccatggtagctaaaatgatccttggcaatgaattggagccgggcgactgcatcaatgtagatgctgatgccaatggcctcacaacaaccacaacacatattgaagactaa

SEQ ID NO: 3244 - DNA, 2142 bp, Coprococcus catus
atgatagatattgaagcaaaactgagcagtgaactgggtgttgaaaaatggcaggtgacagctgcagtacagttaattgatgaggataataccattccttttattgcccgctaccgaaaggaaaagacaggggcattaaacgatgaagtgctgagaaagctttatgaacggctgatctatctgagaaatcttgaagataaaaagcagcaggtcattgcgaccatccgtgatcaggggaagatgacagaagctttgctgaaacagatcgaggaagctcagacacaggtggttgtggatgatttataccgtccatatcgtccaaagcgccgcacaagagccatgattgctaaggaaaaaggccttgaaaagctggccgtagcggtgatggcacagaatctcggacatccggttgaagaagaagctgccgactatgtgtcagaggaaaaaggtgtggcagatgtcaaggaagctttagagggcgcttcggatattttggcagagagtatcgcggatacagcggcttatcgtatgtggatccgacagcagtttgaaaaagagggacgtcttgtatctgaagcaaaggatgacaaagaaaaatctgtctatgaaatgtattatcattttgctgaaccggtatccaaaattgcgggacacagagtgctggcgatcaaccgtgcagagaaagagaagatggtcaatgtaacgattgaagtgccggaagagaagctgattggctggctgaaaagacaggttgttcatcagaagaatccttatacaacagaaatgatggaagcggcagcagaggatagttatcgccgtctgatcgcaccagcggtggaacgtgaagtaaggaatgccctgaccgaaaaagcagaagaaggcgctatgactgtttttggcaagaatctgaagcagctgctgatgcagccgccaatcaaagggcagacggttcttggctgggatccggctttcagaacaggatgtaagttggcagttgtggacccgacaggcaaggtgttggatacggttgttatttatccgacagagccgcagaagaaaattgatcaggcgaaggaagttcttcgaaaacttgtcaggaaatatggtattacgctgatttcccttggaaacgggacggcgtcaagagaatcagaacaggtcatagtagattttctgaaggaaatacctgagaaagtggcttatgtgatcgtcagcgaggcaggcgccagtgtttattcagccagcaaattggcgacagaagaattccctaattttgatgttggtcagcgaagtgcggcatctattgccagaagacttcaggatcctctggctgaactggttaagattgatccgaaggccattggtgtcggtcagtatcagcatgatatgaatcagaagaaactgtccgaagttttatctggtaccgttgaagactgtgtcaataaagtcggggtggatctgaatacggcctctgcgtctcttcttgagtatatttccggcatcagcaagactgtggcaaagaatatcgtggcatatcgtgaagaaaacggacgttttgacaacagaaaacaacttttaaaggtgccaaaactgggaccgaaagcctatgagcagtgtgcaggtttccttcgtatcagcgatggcagtcagccccttgataatacgggcgttcacccggaatcctatgaggcagtcgagaaattactgtctgaactgggcgtggaaccggataagctgcgtgaaggcagccttccaattcgaattgaagattatgagaagatggcggcaaaattatccatcggagaaatcaccctgcatgatattgttcatgaactgagaagaccgggaagggatcctcgagaagatatgccgaagccggtactccgtacggatgtcctggaaatgaaagacctgaagccggggatgattttaaaaggaaccgtcagaaacgtgattgactttggtgtgtttgtggatatcggtgttcatcaggatggtctggtgcatatttcacagctgacaaataagaaatttgtccgccacccgatggaaatagtcagtgtcggtgacgtggtggaagtcaaagttatgtctgtggatcttgcaaaaaaacgtattcagttgacaatgattcttgattga

SEQ ID NO: 3245 - DNA, 2604 bp, Coprococcus catus
atgggaattttcagcaagattatgggtacacacagtgagagagaactgaagagagtatatccaatcgttgataaaattgaagccatgggtcctgctatggagaagttgtctgatgaagaactgagagcgaagacagatgagtttaagaagcgtctgtctgaaggagagacattggatgatcttcttgtggaagcttatgcagttgtcagagaagcagcaacccgtgtacttggcatgcgccattacagagttcagctgatcggcggtgtgatcctgcatcagggtcgtatcgctgagatgaagactggtgaaggtaagacattggtatctacattgccggcctatttgaatgcacttgagggcaagggtgttcacattgttacagtcaatgactacctggccaaccgagatgcagagtggatgggtgaagttcatcgtttccttggattgagtgttggcgtcattttgaacagtatgaatccggacgagcgtcgtgcggcttatcagtgcgatattacttatgcgacgaacaatgaacttggctttgattatctgcgtgacaatatggcagtttatgagaagcagctggtacagcgtgaattgaattatgcgatcatcgatgaggtggactccgtattgatcgatgaagccagaacaccgctgatcatttcaggtcagagcggaaagtcaacggcactttacaacacctgtgattatctggccaaacgtatgacaaagggtgagcgtaagggcgagatcaacaagatgacagtcatgatgggcgaagaaattgaagagaccggtgatttcattgtcaatgaaaaagagaaacatgttgttctgacagaacagggtgtcaagaaggtagaggagtattttcatctgaacaatctggctgatgctgataaccttgagatccagcatgttatgacattggctcttcgcgccaattatctgatgttccgtgataagaactatgtggttaaggatggagaagtactgatcgtcgatgaatttacaggtcgtattatgccgggccgtcgctattcagatggtctccatcaggcgattgaagcaaaagaaggtgtagaagttaagagagagagccgcacgctggcaacgatcacactgcagaacttctttaataaatacaacaagacagccggcatgaccggtactgccctgacagaagaggaagagttccgtgagatctatggtctggatgttatcgagatccctccgaataagaaggttattcgtgtggatcatgatgatcttgtattcggtacacacagagagaagatcaatgccattgttgaagagattattgagacacataagaagggacagcctgttctggttggtacaatcaccatcgaaggctctgaagaaatcagcaatcgtctgagaaaagaggggattccgcataccgttctgaatgcgaagttccatgagaaggaagcggagattgttgcacatgccggtgaaagaggtgcggtgaccatcgccacgaatatggccggtcgtggtaccgatatcaagcttggggatggtgtggctgaactgggcggtctgaagattatcggtacagagcgtcatgaatcaagacgaattgataatcagcttcgaggccgtgccggacgacagggagatccgggtgatacaagatttttcatttcccttgaagatgatctgatgcgtctgtttggttctgacaagatgatgaaggtattcaatgcactgtctcatgaagatggtatggcgattgaacacaagatgctttccaatgctgttgagaaggcacagaagaagatcgagtccaacaactttgctattcgtaagaacctgttggaatatgaccaggttaacaatgagcagcgagaattgatctatgaagagcgccgccgtgtcttgaagggcgagagcatgcatgatgagattgtccgtatgatcggagatgttgttaaagcggagatcaatgatgttattgatgaaggtcagacaccggcagagtggaatcttctgctgctgaaccgtacattgcttccaatcgcaccgattaagccactgtccatgaacaaggatgattataaaggctatacgacagaacgtctgatcgatgaagtgacagaacaggtcaaggaactgtatgcaaagaaggaacaggagataacagaggagacgggctctgcagagacattccgcgaagtagagcgtgtattcctgctgaaagtcattgacaataagtggatgagccatattgatgatatggatcagttgcgtcagagtatttctctgcaggcatatgcacagaaggaccctgttgtagaataccgttatgcgggtattgagatgtttgaagagatgattgctgcgatttccaaggatatcgtgatgatcatgctgcacatccgcaagaaacctgaagtggagcgcaaacaggaagtgaaggtaacaggaacgaacaaggatgattccggtccaaagaaacctgttcagagaaagaacaagaaagttcagccgaatgatccttgcccatgcggcaagtgctatccggatggacgcccgattaagtataagaactgttgcggacgcaatcagtaa

SEQ ID NO: 3246 - DNA, 2313 bp, Coprococcus catus
atgaaggacgataaaaaagaagtaatgggcactgaagagccatttgaggagcaggagctcattcatacacaggatttcgaatcaccgaaggtgctgtatcagcgcctgatcaataaagtgaaggaatatcatccttcagatgatatcagtatgatcgagaaggcatataatattgccaataatgcgcacaaggggcagctgcgtaagtccggagaaccttatattattcatccgctctgtgtagccctgatcctggcggatcttgagctggataaggagaccattgtcggcggacttcttcatgatgtggttgaggacacgatcatgacggaggaggatatcacgagagaattcagcgcggagatcgcactgatcgtatccggtgtaacaaagctgggacagttatcctattccaaggataaggtggagattcaggcagagaatcttcgtaagatgtttctggctatggcgaaggatatccgagttatcctgatcaagctggcagaccgtctgcacaatatgcgtacactgaagtatatgacaccggccaagcagaaggaaaaggccagagagaccatggatatttatgcaccgatcgcccagagacttggtatttccaagatcaagattgaactggatgatctgtcattgagatacctggaaccggaagtgtattatgatctggccagacagatcaatctgaagcgcagtgagcgtcaggcttttgtagatgccattgtggaagaagtcagtcagcatatggcacagagcggtatcaaggcacaggtgaatggccgtgttaagcatttctttagcatttacaagaagatggtcaatcaggacaagacattggatgagatctatgatctgtttgcggtgcgtattattgtggatacagtgaaggactgttatgcggcccttggtattattcatgagatgtacaagccgattccgggtcgttttaaagattatattgcaatgccgaagcagaatatgtatcagtccctgcatacaacactgatcggtccgaacggacagccttttgagatccagatccgtacatttgacatgcacagaacagctgaatacggtatcgcagcccattggaagtacaaggaagatccgaatgccaagaatgtagaggacagtgaggaagccaagctgacatggctgcgtcagattctggaatggcagacagatatgtcggacaataaggaattcatgagccttttgaagaacgacttgaatctgtttgcagacagtgtttattgttttacaccggcaggtgacgtcaagaatctgccgacaggttccacaccgattgatttcgcttacagtattcattcagcggtcggcaataagatggtgggggcgagagtcaacggcaagctggtcaatattgattatgtgatcaagaacggcgaccgtgttgaggtcctgacatcagccaattccaagggaccaagccgtgattggctaaatattgtcaagagtacgcaggccaagaataagattaatcagtggttcaagacggaattcaaggaagagaatattatccgcggtaaggatatgctgaatcgttactgcaaagcgaaagagatcattctcagtaatttgctgaaaccggaatttatggagaaagttatccgcaagtatggtttcaaggactgggatgcagtcaatgctgctgtgggtcatggcggtttgaaggaaggccaggttatcaacaagctgcttgaggaataccagaagaagcagcgaaaagagatgacagataagcagcttctgacacagatgactgagatgaagcagaaaccttctgcagccgtacagccgcataagaaaggcagcaagagcggcattattgtcaaaggcatcgatgatgtggctgtccgtttctcaaaatgctgcaatcctgtaccgggtgatgagatcgttggctttattaccagaggcagaggtgtgtccattcatcgtacagactgcgtcaatatgctgcatttatccgagatagaaagacagcgcctgattgatgcagaatggcaggacagcacggctgacggccagggcggcctgtataaggcagaactcaatgtttatgttcatgacggagtcggtgtgctgattcagatcgcacaggtattctcagagagggatatcaatgtgacagccatgtccagccgttcaggcaagaataatacagcgaccatcaatatcagctttgatattggcggcaagtatgctttaaataagattatagacaaactgcgcagtctggactgcgtttatgatatcgccagaacaactggctaa

SEQ ID NO: 3247 - DNA, 2247 bp, Coprococcus catus
atggaataccaagttttagataaggagaaggacagaatggctagaaagaaaaagaatgatttctgggatgatgtagaagatttgaatactgtttcagataatgatcagaccggagatgatgatacagcagaagttgctgtggatgaagaatggtcagctgtaaagagccttccgctgaaggtgatcatgcgttttctgctgatggtatcgtgtctggtggcacttgtgtcagcctatatcgcttatgaatatgtgaatgatcgttatgccggcggcagctacagcacagatttctttgacagtgcaagttttgcagatgaatataacaagagtatggatcagcttttgcaactggtacaggcaatggaggcagatccttctgtgacccaggcaggcaatgaagaactgctgacaacgcttgttgagaattatatgggcaaggatacgaacttctcatttatgattctggacagtgacaagtatcgtattgctgccagcggtgacgatgcgaaggatcgtattgaaggaagcaatcactatgtggctatttccaatgcggatggccagaccagcattcagagcccaattgcaggtaaacttctgaacaaggatgcatggacgaaggtcctttcggagaccagcaataagtatattatatattcagctgtcgataataccctggcacagccggattcattttacaaggcagagctgtcattcgagaaaatgggtgaatattttggtgctgcaagatttgttggcatcatagcagccgtcatttttgtcatttgtctcattttctgtattatgtcaacaggtatgaagcgtggctacgacggtgtttgtctgacatggtgggacagagtctttacagagattgcactggtggtgatgattgcagtggcaattgccctgggtattggtgttcgcaagctgatgaagatggatggggatctgtatcattatggtgcagcagcactggcaattgtgacttatggatgggtgatccgttcctatttcagtattgtcagacgtatcaaagccggacgtcttctcagatgttccattatcggaacgattgtgggcggtatcagccgcggtattggcaagttgccgtctccattgaatgtgattgttggtgcagtgatcctggttgttattaacggtggattgatttatggggttatcttcatgcgtcagtatacagttaagggtattccggttatgtttattgcagcgcctgttatctttatcatagaattgcttgcattgcttgtacatagtggcggaagtgatgatgaagatgacgaagtcgaggaagagacagaacaggaaccggttgatgaagaagatgatgttagaattgcagcagcacctggaagaaagaatacacaggttcaggagactgagcgtgtgcagaatacaccggcgaatgatgaaccgatggattgggaagcaatggatcttggcaaggcgattgcggaagcagagcgcagccagacccagaagagacagaatacatctgcagatattctcagtgagcagacggtactgaatgtgcaggatgacatggccgaaggaatgactggctatgtggcatctaatgttgtggatgtaacagacggaaagacagaagttctttctgttgaggatgtagagaaagctatcagagaatcaggactgacacctgagattcagccgcgtccacaggcacagccggttcagacagcacagacggtaagacctgctgaagaaacagttgtgaatatggcacctgtgaaaccggtgaaagaacagccgacagcaaaacagccaattatggaagcagcagatgacggcagagtgaattttgtacagctcaacaaggatgtccgtaaggaattcagagcagcactcaaggccagaggtgtcggcgtcacagtgcgtgcgccggagaaaccggtgattattgatatcgacagaaacagtctgaagatgattattacagatatctttacacagattgagcgtttctcagcagacaatgagcgtgcatacgtggaagtttatcgtcaggacggcaaggtggtttacattgtgaagattaccgttgctccggataagacggaagaagcggtcaaggccgctaccggtgacaacagttttgacaatgcaagaaagattgttgaagcgaatgcaggacgttttgttgtggcgtttgataatggcatgatgaaagccggcatgatgattgatgctgcggaataa

SEQ ID NO: 3248 - DNA, 2940 bp, Coprococcus catus
atgacagacaaatttactcatattccggcggcctatgaaatcgtcagtctggaatatatagatgagatcaaatcccaggcagcactgctcagacacaggaaaaccggtgcaagaatcgctgttttggctaatgatgatgaaaataaaaccttcaatatcggtttcagaactcctccaaaggacagtaccggcgttgcccatattatggaacactcggttttgtgcggttcagagaagtttcctgccaaggacccttttgtagaattagcgaagggctctcttaatacatttttgaatgcgatgacctatccggacaagacggtttatcctattgccagctgcaatgatgcagattttcagaatttgatgcatgtctatctggatgccgtttttcatccgaatatttatattcatgatgagatcttcagacaggaaggctggcattatgagttaacagacaaggacgcaccccttatttacaatggtgttgtctataatgaaatgaagggcgctttttcagcacccgaacagattttatatagaaagatcaccgatacactgttcccggacaccatctatagtgtcgagtccggcggtgatccggatgtcatcccacaactgacctatgcgcagtttctggatttccacaggaagtattatcatccatccaacagctacatttacctgtatggcaatatggacgtggcagagaaactggcttttattgatgaagcatacctgtgccaatttgataatacccgggtagattccgctattgcaaagcaggctccatttgcccacacttctgtcacccgtggtgaatacccgatcggcaatgatgacagagaagacaatgccgcttatatggcatacagctgggtcgttggtgacagccttgatgccaagctttgccttgggtttcagattcttgaatatgcactgatggaagctcccggagcacctttgaaacaggcgcttttagacaaagactttggggaagatatctatggtatgttcgagacaagtttgatacagccatatttgtccattatcatcaagaatattaatgaagaagacagagatgaaattgttcaggtgatccaaactgaattagagaagctggcagatggcgggctgaaccacaaaacacttgaaggcgccttgaattattatgaatttaagtcaagagaaggtgatttcggccgctggccaaaggggctgatgtacggattacagttaatggacagctggctctatgatgacaataagccttttgttcatctgaaattccaggcagtttatgatgaattaagagagggcctttccaagggatattttgaggacttgatccgacactatatgattgataatacccactgttctgtttatctgctttgcccatctaagggactcgcagcaagaaaagagcaggcattggctgatcagctggcagaatacaaggcttccctttcagaggaagaactggagcagctcattgcagccaccgaagaattgaagcaatatcagagtgaaccatcgccaaaagagatccttgaaatgatcccgctgctgacaattgatgatatccgcaaagaggctgaacctatctacaataaggtgttgtcggaagaaggtattgctattctgcagcacgaaattgaaactaatcgaattgcttatgttgatctgctgtttgatatttcccatatagatgtggatgaggttccttatctcggcatattgacagaagttcttggcaatatgaacacagatcactatacctatcaggaactgacagatgaggtgaatttatataccggcggtcttcggacagcagtgaacatttacggtcttcagggcagtgatacttataagccacgatttgaaatgtccggcaaagtcctgtacagcaaagtgccaaagatgtttgaattatttgaagatattttacttcatacccattttgatgatgagaagcgtctgagagagattctaaaccagctgaaatcccgtctggaaatgggctttatgtcaaatggtcattcaacggctgtaaacagagccatgtcttatttcaaccagggcagctggtacaaagaactcgtagaaggcattgctttctatcagttcttgtgtgcgatactgaaagattatgacaccagaaaaacagaaatcattcataaattgcagacaatcggtcagaagattttcagaaaagcataccttatggcggatatgaccgttgatcatgaaggcatgcagatatgtacaaagccactcgtatcctttgccggcaagttgtacactgcgccgatgagcgctgtcgactgtgcagtcaaaaccatcggcacatgcccgagacacaatgaagcttttatcacatccggtatggtacagtataatgcctgtgtaggcaattttgggggatcaggtatggcttacagcggcagtatgaatgtgctgaagaatgtgttgggcaatgaatacctctggaataatgtcagagtcaaaggcggtgcatacggctgtatgtgtggttttgcgccaagcggcaatggttatttcacttcttacagagatccgaatcttgcaaagacttatgatatttatgcgaatgcagccgactatgtccgatctctggcattagatgacagagaattgacgaagtatatcatcggtgccgttggtgccatcgacctgccgatgacagcttctatgaagggaaaccgttcactggcagcgtttctcggggaacgcagttttgaacagatacagaagaacagagatgagcttcttgcaacaactgttgacgatctgagaggcctttcaaaggctgttgcgtcagtcattgaagccggtcatatctgcgttgtaggcagtgaaagcaagatcacagaagaaaaggaccgttttgaatatgtggcacagcttactcaatag

SEQ ID NO: 3249 - DNA, 1830 bp, Coprococcus catus
atgtctgttgatcgaactgaaaataaaaacgacaggaagggacttgcccaggtgggttactgcctcaaatatctgatgaattttttgcgtccgtataaaggcggcctgatccttggtctgctgatggttgtcgtggccaatataacatttgcggtgatgccggtggtggagggagagatgacaacacagctctttagtgacggggaagcgatactgaagggcgtggaaggtgcacatgtccattttgatgtgattttcggaatcatggggacgctggtgattatttatatcatcaaaacagtttctcagctgatcacggctgtttttctgacgcgggtgctgcagcaggccatgtgtgatatccgtaatgctttgcagaaaaagattcagcggctgccggtgcgttattttgatgatcatgcttttggggatgtactcagttgtgtgaccaatgatgtggatacgctgagcaatgcgctgcaggaaaccctgcagagagttctggcagcgattctgaccttcatttttgttatagggatgatgttttacattcacaccattttggcctgtatagcgattttgatcattccgctgtcactgatcgtgacccggttttttgtaacgagatcacagaaattatttgatacacagcaggaaacactgggggagctgaatggtacgatcacggagatgtacggcggttttaatgaaatcattttatataacaggcagaaaatggctctggataaatttcacgatgtgaatgacaggatgcggaaggcttcttttagggcacaatttgcatcctccctgatctcgccgtgtatttctctgatcacgtatctgattatcggttctgtggctgtaacgggctgtttgtttgtcatgaatggaacgcttttgcttggcaatcttcaggcctttgtccgttatatctggcagatcaatgaccctctgtcacagatttcccaattgtcttcacaggtacagtctgcctttgcggccatgggaagaatttttaatctgatggatgaggaagaggaagtacagaatggcaaagtcgagatccgaccggacaaagtccggggtgaagtcacttttgatcatgttgtttttgggtatgatgatgaaacattaatgcgggatgtgaattttcaggcgaagccgggaaagatggtggcgattgtaggaccgaccggggcaggcaaaacaacattgatgaatttgctgctgcgtttttatgatgtaaagggcggagctatcaaaattgacggtattgatatccgggatatgaacagggaagaactgagacagcttttttcattggtactgcaggatacatggctgtttaagggcagtatttatgataatattcattacggaaggctgacagccagaaaggatgaagttatttccgctgccaaaatggccaatgtgcatcattttatcaaaacactgaccggcggttacaactttgagatcaatgaggaaagcagtaatatttcacagggagagaagcagcttttgacgattgcaagggcgattctgaaagatccacggatcatcattctggatgaagcaacttcgtctgtggatacccgtctggagaaaatgctgcaggatgccatgcataaagtcatggacggcagaacatcctttgtgatcgcccatcgtctgtcaactgtcaaaaatgcggatctgattcttgtggttgaccatggtgatattgtggagcaggggactcatgaggaacttctggcgaaaaaaggtgtttacgaaaatttatatcacagcggcacatcacttgcgaatcatcagccagtgtgctaa

SEQ ID NO: 3250 - DNA, 1698 bp, Coprococcus catus
atgtcaacaaaagcttattatccactcaacgaaatcggtgccggaaaagttggtttttccaagacacgttctatcatcgaagctgccttctacggcaataatgttgtcaaagtcaacacattgaaagaagcttataatctggccaagaattcacctggtacgatcgtaacagatatgcctgtttacagaggtgaagaattcggtcttgacagtgatgcaagagtacttctgttcaatgacggtgccatcacaggccgttacgcaacagcccgacgtatcgcaggcgaacccggcgttgactgtgacgcactggacaaagttgttatggatgccgtttacacggcaaggttcaagaaattgtatcatgcaaccgtttacgcaggccttgaccctgaattcatggtgaagtgccacctgctgattcctgaaggtgaagagaacattctttacaactggatgctgaacttccagtatatgtccgatgactatgttaagatgtacaaagcttccaaacctgtcggcgacggcaaagaagcagatatctatattttttcagatccacagtggattccgaacgaagcacctggtgtcagccttgactgcttaagcgatcctgccaagaagacactctgctatttcaatacagagacaaactgtgcatgcatccttggtatgagatactttggtgagcacaagaagggcacactgacaatggtatgggccatcgccaaccgcaacggctatgcttcctgccacggcggccagaaggaataccttcttcctgacggctccaaatacgttgcttccgtttacggcctgtcaggctccggcaagtccactctgacacatgccaaacacggcggcaagtatgagatcaaagtcctccatgatgatgctttcattatcaatacagatacatgctcatccattgccattgaaccgacatatttcgacaagactgcggactatccgacaggctgcgctgacaacaaattccttctgacagctcagaactgctccgctacaatggatgaggacggcaagatccagcttgtcacagaagatatccgtaacggcaatggccgtgccatcaagtccaagctctggtctccgaaccgtgtggacaagattaacgcccctgttaatgcgatcttctggattatgaaagaccctacaattccaccggttgttaaactgaaaggagcttcccttgcttccgttatgggtgccacactggcaacaaaacgttcttctgcagagagacttgcgcctggcgttgacccgaacaaactggttgttgttccttatgccaacccattcagaacatatcctctggctaatgactatgagaagttcaagaaactggttgaagagaagcatgttgactgctacatcgttaataccggcgatttcatgggcaagaaagtccagaaagaagatactctgggtatcctcgaagctatcgttgagaaacgtgctgatttccatcagtggggtccgttctccgatatcgagatcatggattgggaaggttttgtgcctgatatgcaggacaagaactacacagatcagctcaaagcccgcatgaacgaccgtgtcgacgagatcaaagctttcgccacagaaaaagagggctatgacaagcttcctgatgatgcactggctgctatccagaaggttgttgacgaactgaaataa

SEQ ID NO: 3251 - DNA, 1425 bp, Blautia sp.
atgaaaaaaaagacagtgtgtgtgctgacagtaattttatgtgcatctttaggattaagtggatgcagcctgtttccgtttgagcaggatcttccatttcataaatccgaaactgagaatacagatgtagaatcagcagggaatacaccactggaaactgaggaagaacagaatgccgaaacagatgaagatggaaacgatacacaggaaataactgatgagcagtcagaggaagaagtggcttcaccgctggaacaggcatcgcttatggctgcacagtatgattatgacgaagcgatagaacttcttaagagccagccggcttatgacagtaatacggatatgcagaatgcggtttctgaatatgaaaatacgaaagctgcctgtacagaatatcctctggaacagattacacatgttttttttcatacactgattaaagatacctcaaaggcatttgacggtgatactgattctgatggatataatcagtatatgacaacgattgatgaatttaacaagatcatacagagtatgtatgataagggatatgtgatggtcagtcctcatgatatggcaacagtgaatgaggatggaaccatgtccagaggaagtatcatgctgccgcccggtaagatcccatttgtgctttcgcaggatgatgtgagttattatcattatatggatggcgatgggtttgcatcaaaacttgtggtagatgaaaatggcgatgttaaaaatgaatatattgaggatgatggaagtgtttctacgggagattatgatatggttccgctgatcgatactttcgtaaaagaacatccggatttttcctatcatggcagaaagggaatcctggcaatgacaggttatgacggtgttcttggatatcgtacggacattgcatataaaacaggaaagaacctgcaggatgatcagaaaaagttcctcagggatcatccggattttgattataagcaggaagtaaaaaatgcaaaaaaggtagccgcagctatgaaagcggaaggctgggaatttgccagtcatacctggggacataagaatgttgcatcaacctctctgaaagatctgaagagagatactaaaaaatggaagaaatatgtggctcctgttcttggaaaaacagatatgatcatttttgcatttggtgcagatatcggaagctgggaaggatattcttcagacaatgcaaagtatgagttttataagagccagggataccggtatttctgcaatgtagattccagtcagtattttgtacagattacggatgattatttccgacagggaagaaggaatctggatggatatagaatgtattataacccggagatgctcagtgacctttttgatgtatctgaagtgtgggattcttcgcggccgactccggtaccgaaaatatag

SEQ ID NO: 3252 - DNA, 2472 bp, Blautia sp.
atgagaaaaaatatatcagaggaatctaaaacaaagctgctgcttatggcagctttgtttgtaagctgcctgtttatgtttcgggagtatctgtctggtgatcttgttatggtatataatgatgtgggcggcgatacatggcagcaatatacggcgtattatgcaagtgttgtgaatcatttgcgggcggggaactttgcactgtgggattttaccaatggaattggaattaatcttttttcctggtttcagatggatccgtccctgatcctccttctgatgatcggggttatacttggacctgcacacatgctgtattatctggtggttttacagatgatgaaaattctggcagccggaattgtgttttatatgtttctctcggaattttcttacagtaaacaggcaaaatttatggcggcctttgcttatggaatgaatggttatctgctgatatgggggcagcattatcagtttggaatggttactgtgtattttccgcttatgcttctgtttgcggagaaatatatacgcggaaaaaaggggaaaacttttttctgtgtggttgtgtttctgagtggaatctacagcgtatatctgtcttatatgagcctgatcggaatcggattttatctgctgttcagatccattatgacagaagaaaagccgggtgcagcatgccggaagttttttatcggatgtgcacagatcgttctgggaattggtatgagtctgggaatatttctgcctatggcagagggtattatgaattcttccagggtttcttctgcatcaggcagtattctggaaacattgaaaaactatctcctgccatataagaatgtcaattattataattcgcttttgatccgaccgttttctaccaatctgcaaaatctgcaggaactgggaaatgcaaagtatgagggatataagaattactatgaagatcccatattattctgttcgacactttccgtgatatttctggttcagtttcttatcgtattccgaaaaaaagaaaaggacagaaaagtcagaggatgtgtttactgcgcagcggtattaatgctgtttacattattgctgcctcttggcggacgtgtgtttaatgcatttacagaaacgcctacaaatcgttatacatatatattcatagcattttttctgatagcatttgcctggatgtgggattatctcaggcagggaggcagaatcaatattctggccctgatgatcacagaagtattgatgcttagggcatacttttgcgggtattcggacagcgtttttggggagtacagagaaaatgccatgattcttgcagcaacaggtactgttatgatcgtatgtgtgctgtatctgaacgtcagttccgggaaaaagggaagaaaactggttacaggattgctgacggtaatggtatttgttaacgtaatatcagaaggtgggataacgtatacggatcgcatctgtctgagaaaaacagataccccacaggaacagactgcggcactggaagaagaaactgcacggcttgaagcatcggaggattcggaaacccaggcaaggacagtgctgaacagacctcagaactattacagaggtctgtataatcaggatattcaggatgcattgaattatttaaaggaagcagatcatgaattttacagagtggagaaagatttctcgtcaggaactgtttcaatggattcacagatccagggttacagaggagtcagtacatacaactcggtcatgaacggaaatgtaaaagaatttgtaaatacctgttatccggagtttctgtacatggacaggaaccgatatacgttctggcctattgcacaggatacattttttgcttcttttatgggtgtgaggtatcttatttcggagaaaccggaccttgatgatacgaaatataaatatcttcgacagtttggtcagttttttttatataaaaatgtaaaagaggcagatattgcgaggttttatgagaatactgtttctgaagaaagtcttagaaaattatgtaccggaaaaaaaagaaagaagaacagagagcgtattctggaaaattatctggtgacagaggatggggcagatatttcagatctttccgaactgacagagattccggaagcacagaaaaaatctgcagtcacattagatgcggcagagaaagattcacatttgaccggaagtgtatcggcgcaggcagatggttatgtaatgtgcatgattccgtgggaaaaaggctggacggtgactgttgacggagagaaagtgcagacccagaaaggagatctgggatttcttgcatttcaggttgataaaggtgaacaccagctggaactgacttatcaggttccgggactgaaggcaggaatggctgcaggtgcggtctgctggtttatctatatttccatatgcttttatcagagcagaaaaaagaaaagaaatttataa

SEQ ID NO: 3253 - DNA, 1614 bp, Blautia sp.
atgtatttaagaggatttgccgtaggtaaaatgtatcagggaaaggattggcttatggtgaaattaaaaaaagaaagtgttcagatgctgcatgtgaagaataaagcagtgacccaggtgacttttgatgaggattataatgtaccggatgtcaaaccggacattggaaggctggtacagagtaaaacggatgtctctatggatgaagtgcgcctcagtgaagggaaggcgtttcttaagggaactttgaatgtggatttgctttatgtaggggaaaaagagggcaggatctgcagtctttctgcgaagcttcctgtggatgaggatattaatctggagggaatcgaaggtggcgataaactgtgtctgaactgggagatcgaggacctcagtgcccatgtgatccattccagaaaactgaatctcaaggcaatcgtgaccttctatgcagaggtagatgaactggagaaaatggaggtccctgtttcactggatgatccagaagtttcggtaaagaagaagccgattcagcttatgagtctgtgtatacataaaaaagatactctgcggatcagggatgatattgtgcttgcgtcaaacagaccaaatgtggaggaacttttatggtatactattgaaccgcggaatctcgaactgcgcccgaaggaaaataaacttcaggtaaagggggaactggcggtctttctgatatatacaggatctgaggaagaaaatccaccgcaatggctggaatataccatgccatttaacagtgaaatggagtgcagtggctgtgaggagaatctgattccgcatatagagccaatgcttatccataaggggatggaagtgaaaccggacacagacggggaggaaaggatcctgcaggtggatgcggttctggaactgaatatgaagatgtacagggaggaagaacatgaactgcttctggatgcatacagcccgctaaaggaatgtgtactgtatggcaaaaaaagaatgctggagagtcttcttgtgcgaaattcctcgaaatgcagactgacagaccggatagaagttaaagaaagtcagggaaaagttttgcagctctgtcatagtatcggtaaagtaaaaatagataagaccaggattacggataagggtattctggcagagggaattatagcacttaagattctgtatattatcggaaatgatgagatgccgttttattccatggacgcgatgcttccgtttacgcatctgatcgaggcgaagggtatcgggcaggactgtacgtattttcttcaggcagatctggaacagctttctgcggcaatggcagatggggatgagattgaggttaaggtgactgcaggactgaatgcattggtgttcagacagtgggaagagcagattcttgagtctgtggaggaaaaaccgctggaccgcaaaaaaattgagagcatgccgggaattacggtttatattgtgaaagccggggataccttgtgggatattgccagaaagttctatacgactgtggatgaaatctgtaatgtaaacggccttgatgaaaaagatgtggaaccggggcagcagttaattctggtaaaacaggtgccggagtaa

SEQ ID NO: 3254 - DNA, 2220 bp, Blautia sp.
atgatatatgctgatataataattgatatttccagtgataaactggatcggagttttcaatatcgtataccggagagactggagaaggaaataaaagcagggatggtggtggccatcccttttggaaattccagtcagcttcgtaaaggatatgtgaccggattgtcagataaacctaagatcgctcctgaaaagattaaagaaatcagtaaaatctgcagcggagaggagactacagaatccagacttattgctttggcagcctggatgagggaaaattatggttctacgatgatacaggccctcagaacagtacttccggttcaggagaaaatcagggcaaaagaaaaaaaatatatatgtctggccatttccgaagacgcaggctgtcagatgctgaaagagcttgaacagacaagatttaaggcaaggacaagacttctgcgggaacttctggaaaaaaaacggttggattttacccgggcgtcgaaagaactgggcgcgacctctgctgttgtaaagaaaatgaaagagcaggggattatccgcatagaatatgatgaaataatgagaaatcctctgaacatcgatgatattacggaagaagcgccgatgctccttacagatgagcaggaagcggcagtgagacagatacaaaaagagtgggaaaagccctcaccacgtcctgtgctgatcgagggtgtgaccggaagcgggaaaacgcaggtttatatgaagctgatcgaaaaaaccatttctcagggaaaagaggcaatcgtgctgattccggagattgcgctgacatatcagacagtacgcaggttttatgccagatttggagataaagtatcagtcatcaattcaagacagtctcagggagaacgctatgatcagctcaggcgcgcaaaaaggggagaaatccagataatgattggtcccagatcagcattgtttactccgtttgccaatctgggactgatcattattgatgaagaacatgaaccaagttataaaagtgagagcagtccccgttatcatacaagagaaactgcaatccagagggctgcttttgaacatgcaaatgtagtgatgggatcggcaactccctcagtggaagcttacagtaaggcaatgaaggaagaatatggtctggttcgactgaatgtgagatacggaagcagaccgatgcctcaggtttccattgtggatctgcgggaagaactaaaggcaggaaatcggtctgtactgagcagagaacttcgggaaaagatgaaaagccggtttgagaaaaaagaacaggtaatgctttttctgaaccgcagaggatatgcaggatttgtttcatgtcgttcctgtggacatgtgatgaagtgtcctcattgtgatgtttctctctcagagcacaataacgaaagacttttgtgccattattgcggatatgaaacaggaaagccagagacatgtccggtgtgcggttcgccttatatcggcggatttaaggcaggaacacagcagattgagaagattgtgcgggaaacctttccgggaatcaggactctcaggatggattttgatacaacgagaaccaagggcagctatgagaaaatccttgcagcttttgcggctcatgaggcagaggtgctgatcggaacgcagatgatcgttaaaggacatgatttcccggatgttacactgatgggagtagttgcagcagatctttctctgaacgctgaggactaccggtgtgcggaacgtactttccagctactctgtcaggcagcaggccggggcggtcggggggaaaagccgggagaagcagtgatccagacctatcatccggatcattacagtatccaggcggcagcagtgcaggattatcaggcattctatgaggaagaaatgagttaccgtatgcttctggactatcctcctgcggctcatatgctggcagttcttggctctggccctgaagatgagaagctgacccaggctatgcattacctgaagctttatatagaaaggatatacaaagaaaatgacctgcatgttatcgggccggcatatgcggcggtcggtaaagtaaaagatatttacagacaggttatttatctgaaacataaagattataaaactctggtgcatatcaaagaccagatggagaaatatatagagataaattccggtttccggaaaatatacatacagtttgatttcagttaa

SEQ ID NO: 3255 - DNA, 1242 bp, Blautia sp.
atgtttaaaaagaaatttcatacactgataaaacgctctctggccggtactctctgtctgggactcctggcttcacagcctgcagtggcttatgccacagaggccaacgtttctgcaactcctgaagctgctcattctgcgacttattctcaggccgcagacacagattccgtcaaaggatggccatccggtccctgcattgaagggcagtctgcagtattgatggatgctgttacagataccattctttattccaagaatgcagatgacaaactttatcctgccagcattactaagattatgactgcactccttgcctgcgagaatctgaaaatgagtgacacgatcaccatgtcgcaggaagctgcctacggaattgaagcaggaagctctaccatctatgcggaaactgatgaggtttttacagtggagcaggctctgatggctctgatgctggaatctgccaacgagatggctctcgcactggcagagaaaacaagcggttccgtaaagaaattcgtagaattgatgaaccagcgcgcagcacagctcggatgtaagaatacgcattttaataatccaaacggactgccggatgaaacgcactatacaactgccagtgacatgatgaaaatcgcaaaggctgcctggtataatcctctgttccgcaaatttgtcacaacacagacttatgagattccacctacaaacaagcagtctgaaacccgctatcttctgaatcatcacaagatgatggcaggtcagtcctatgcttatgacggtgtgctaggaggaaaaacaggttacacgaatgatgccggaaatactctcgttacttacgcaaaaagaggtaattccattctcattgcagtagtgctgaattccacaaacggagctttccctgataccacttctctgtttgattacgggtttgacaacttcgagaaggttgacctgaatgttgactccgatcctgcaccgacgaaatttctcccaagtgagaaatacctgttgaaaaacaacggcaatacctatcctttctattatatgaggcatgtgtatgtgaccgttccgacgggaactgatgtaagcactcttaccagaaagcagtggcttctgaacaattccatcggtccgaagcggatcaagagtaaatattattttcatgaccatatggtcggatacggaatgcaatatgaaaaagagatcctttcagatctccttctcaacacttctttttag

SEQ ID NO: 3256 - DNA, 1296 bp, Blautia sp.
atgaaaaaagtgatcacgtatggcacttttgatctgtttcataagggccactataatattatcaaaagagcgaaagcacttggagattatctgattgtaggagtcacaagtgagagttttgatattgagcgtggaaaattaaatgtcagggacagtcttatcacacgaattgagaatgtcagaaaaaccggtctggcagatgagattatcatcgaggaatatcagggtcagaaagtcagcgatatcatcaagtatgatattgatattcttgtagtgggttcggactggagaggcaagtttgattatttgaagaattactgtgatgttatttatctggagagaacgaagaatatttccagcacgaagctgcgcagtgaaggtattatttttaatataggagtggtgacagacagtattgaagataatgatttcgtacaggaatccaagtatgtcagcggaatccatgttgagagagtgttcagtgaggaacaggaagttgcacagcgtttctgtgataaatatgagctggattcctgctggaatgattacggggagttcctgtcagatgtggatattgtttatgtgaagacaggactgaataaacgcgcagagtatatagaaactgcgctgaaacacggaaaatatgtgatcagtgattcaccgatgacactttcttcggacaggctccgcaggctgtttgaacttgccagagagaataacgtggttcttattgagcgtatgactctggtatatctgcgcgcatttaaccagttagtatggctggtccacagcaatctggtcggcgatctggtaagcgtcaaatgctcaatttctcaggatgattttgacggtggaaggacatttaacgaaactgtctgcacggcaatctgtgcggttctcaaacttcttggaaaaaactgccaggaagtaagaaccaatgcagtccgtaatcatgatggtgaatttgtatatgacatgatttccatgaagtatgaaaatgcacttgcgaccattgagatcggaacaactgtagatatcgagaatgagcttgtgatcatcggaagcaacggacgagttaccattcccaatgactggtggaatacgggatatttcgaagcaaatatctcaggtaaggaatttctgaagagatacagttttaacttcgaaggaaacggattccgttatctgcttcaggagctgatgatcatgatcggagacaaacggacagaatgcaccagacttttttatgatgaatctgtaaaaataatagaaattctggaaagaatcaataaatag

SEQ ID NO: 3257 - DNA, 1803 bp, Blautia sp.
atgacgatctctgcggagttttttatgaaaaaaaacatgacatttcataagaaaaaagtatgggtggtattactcggctgtatgttgctgatggtgggactcatgggcagactggtatatcttatgtgtttcagatcagattattattatgagaaggcaaaggaacttcatgaaagagagcgtgatatcaaagctgccagaggagagattctggatgcaaagggaagagttctggcatcaaacaggacagtgtgcacaatctctgtgatccacagccagattaaagaacctgagaaagtgatcgctctgctgtctgaaaaactggaaatggatgaggcagaagtgcgcaaaagagtagagaagatttcttctatagaaagagtaaagacaaatgtggaaaaaagtacaggggatgagataagggagagtaatctggcaggtgtgaaggttgatgaggattacagacgttactatccattgggaagtctggcatcgaaagtcattggttttacaggcggcgataatcagggaattatcggtctagaagtaaaatatgaagatatcctgaaaggaaagccgggcaaaatcctgacaacaacagatgccagaggagtggaaatcgataaactgggtgaggccagggaagatccgacagatggaaaaaccctgatgatcagtcttgatgcgaatatccagaaatttgcacagcaggcagctttgaaagtgatggaagaaaaacaggccgagcgagtatccattctgctgatgaatccccaaaatggcgaaatatatgcatgtgtcaatgtgccggaatttgacctgaatgatccgtttgctctgacggatgatctgaagattcaatcccggatacggacagcagggaaaacagatacagaaagaaaacaggaattactgaatcagatgtggagaaatccctgcttgaatgacacgtatgaacctggttctacatttaagatcattaccatggcggccggactggaggcaggtgtcgtttcaccaaaagaccgtttctactgtccgggatataaagtggttgaggaccgcaggatccactgtgcaaaaagaacaggacatggttcccagaattttgtggaaggagcacagaattcctgcaaccctgtgtttatcgaggtagggcttcggcttggaacagaccgttattataaatatttccgacagtttggacttctggataaaaccggggcagatcttccgggagaagcgaaaactatcatgcatcagatgaaaaatatgggggaagtggaactggcaactgtttcctttggtcagtctttccagatcacacctgtccagctggctgctacagtaagctcgctgataaacggaggcaggcgggtgacaccgcattttggagttgcagttttaaattctgacagaacagagggtgaaaaactaatctttccggtgaaggatggaatcgtatctgagaaaacgtcaggagaaataagaaaaatactggaaacagtggtgtctcagggttcagggaaaaatgcaaaaatcgaagggtatgctattggcgggaaaactgccacttcccagacattgcccagaagcgcaaaccgttatatttcatcctttctgggatttgcacctgcagatgatccgcaggtacttgggctatgcattatccatgatccaaaaggtatttattacggaggaacgatagcagcaccggtgatccgaagtatatttgagaatatacttccatatcttgggattgaaaaaagcaatactctggatcctgtcgttgaaggcaattag

SEQ ID NO: 3258 - DNA, 2616 bp, Blautia sp.
gtgaaaagaagagtagttgcagttacattgagtctgattatgacaatggcaactgtcagtgaagccggagcagcggtatttacttctcctgacggagatgacaatgtaattgtacagcagtcagaagaagtaaatgatactgagcagcaggaaacagaagtgactgaagacatcttcacttccggagaggagcagacagcacctcaggatcagacagaggatgtcttctctgcaacagcagacggtactgaaacaccggcatctgctcagataacgtcagcaacgtcagaggcagtgacagcagatgcgtcaggagcacttgtggtaaatgcagaagactggatccgtgagggaaatgagtttaagcttcagaaacaccaaaagacagctcctgttgcaaacgaacagcaagcaggtaatgcggactcagaaaataaggcagatgtttctgaagaaggaacagagaatgcagcttctgcaaacacagagataacagatgcagatgttatattagacacagcgaatgcgtcagatacagatgtggcagaagatacaaccagtgcgtcagatgcagatgttgttacagacacagcaaatgccgcagatacagcaaatactgcagatacaactttaccggatacggatgcatccggaaaggatgatttctatacagtaatggatggaatcataaagatcaatacagtgtataagggagagagccatacaggatattatctgtttgatgaaaacggttttcttgtaaccggacaggctgaagtgcagcttaaagatgatgggacggtagttcttgctgatggggctgcggaaacttcagcagatcttatgtattttacagaaacagatgatgctgtcatttatagtggctgcgagggtgagactgttacaccttatacatctactgtaggtcagcaggtaaggaatgagtggaaatggacaggaactgtctttcagtattatgacaaagacggtaaactgaaaacagtagagcagcttgagaaagaagcaaaagcagcagacacttataccggttattttaagattgatgatgagtactactgcctagataaagatggtaaaccgagaaccggtgatatcactcttactgttaatggagaatcaaatctgtattattttgaagaagacagtataatccccggaagaatgttccatgagggatggcgccgtgcagatgatgaaaaaggagaacgctggttatattatcagatgggaagtaatcctgcaaatgtgggtaaatattataaacgtggcgtgatagctacaagacttggtacagatacacctacatatctgcttgatggcaatggttatgttcttaagtcaaagcttaagaaagcttccaacggtgcttactatggttcggacagtaatggtatcatttataaaaatgcaatggttaaatttggtaattacagatattacttcggatcaagcggcaaaagagctacatggaaaaagagatgggcaaaagtaggaacccattattactattttggaagtgtagccggacgtgtagttgagaaacatggatggaatgcaataacaaatacaaagggcaagtttatcggatggttctattttgatgccaatggaaatcattatactgataaatggacatccaatggatactatttcatgccgtcaggaaaactggcaagtggttttgtggaaattaatggtaagggttatctgtttgaagtttcttctgctgcagaacataaaggtaaagtatacaaaaacactatggtgcgttataaaaagaaatggtatatcgcatcttccacaggaagcctgtataaaaacggatggaaaaaatttaataaaaagtattattatctgaaagattatgtagttcagactaacttgtttgcggcccgtaatggtgtaaatggttatattgattcaaacggagtattcagaacaggctgggttgttataagtaatgcggcaaatactgtgaagtatattaatccggatggaacaggatttgtgactaatacaagtaagtggatcgatggtatgctgtattactttgacaaaaatggaaaccgtatcacagatctgaccagcagatataccggaccgtatactgtacaggtagacagaactaatggtgttatgacgatttttgccgattcggccagaacaattccggtgaagacaatccgtgtatcagtaggattacctggcacaccgacgcctacaggaagatttacactgagcagaagttcaagatggcagccgttgatgggaccgtcatggggacagtatggaactcatgtagacagagctggtcagggaggaatctttgttcattctgtagcgtgtggtcaggcgaactctttcaaccttccggcaggtgaatacaataaactgggatatccggcatcacacggatgtatcagagtctgcgttggcgatgcaaaatgggtatattataactgtaacggatcggttatttacatttttgacggtgcttataaggctgatgatgccttaaagggacctcttggaaagaaacctctgactccattaagaggagctggaaattacgatccgacagacccggcggtttaa

SEQ ID NO: 3259 - DNA, 1845 bp, Blautia sp.
atgccccaaatattaaaacatgatctcagtatttttatatacgcaattctcagtacccttttctttacttttgcgttcacagaagatcatgtattttcccttttttcaggttcatctgtcatttcatcctgcatactgattgtcttatttctggcatataaaaaaatcatccggaatcagcctgacatatccggtattttttttcagatactggcaggaattattgtaatagtttttaccatatgttccattatgggagtattctattccgcagataccagtctgaaaattgctatcacttcgcaaaaactggttttacccgagctgctgcttgtgtttctgggtggagcaatctttttccggataatgctgaaagcaattggcagtctgccacatctccataacctcaaagtttctgagatatttgagacattattttcttttttatttgaaaaaaaatgttttctcaaatcttttatagttatgggaattctgtggcttccgcacctgattatccgttatcccttcacagtcccggtagacagtgaagtcagccttttacagtattatggtgtccgctcatatacctcgcaacatccaatcatttacacgcagcttctgggacgattttccgatctgggtgcggcacttggcagtccggtcatcggtctgactattctggcatttatccaggctttatgccttttactggtacttgcctatacaatttctaccatgaacagatttaatgttccccgtcactggctatttggaacacttattattttttccgtttcacctgtcattgcaggatacgttacttctctgctcatcgacattttttacaatgctgctattctgctgttgatgaatgaactgacatggtatattttcagaacagatatttacaaaaaggacctgaaacatccagttcttacagttatcgccgtactcggtatgtttttccgacaaaacggtttttatgttgttgcagtcctgattctctttgctgtatgccgggagatatatctcatcctgcacagaaaacaaaccatacgctgggcaatcctgtttcttgcattgctgactgtacctttatgtataggaaaggtaaatacctctttcttatatgaaaaatataatgtagaaaaaatttccacacgtgccatgttcgcacttccactgcagcaaactgcacgttatatgctttatcacagtgatgatttgtctgatgacgaattgcaatctatttcttcagtaatcaaatatacacctgaggaatacgccagccattacaatcctgctaattatgacggaatcaagcacggctttaataataatgtttcatccagagaacttctcgatttccttcatacatgggttaaattgttttttcgtcatccaggaacgtgcatcaatgcaactttaaatcagaattactgcctgttcagccctctgaaagataattcaaaatattatttgggcgtcaggaaaaaaattgtccagattaaaaatcctgattattctgatgtttatcaggcagtatattctaatcaggaagcaaaagcggctctaaactcttattatctggaattcagcaacattccaatattaggtctctgtgtaaatcagggctttaccgattttctgctcctgacagtatgtctttacgctttatgtaaaaagaacggcagacttctgcttctcggactgcctttactgcttactcttgctgttaccttcatcggtccggcagcattgggacatccaagatatacatttccgatcatctatgctctgccgctgtttctcggaatttttataacttccgaatccctttcataa

SEQ ID NO: 3260 - DNA, 1941 bp, Blautia sp.
atggattacagaaagacagctcaggaaatatatgaccacattgggaaaaaagagaatattatttccgcagctcattgcgccacacgtcttcgcctggttatcggcgataattcaaaggctgataaagaatatgttgagaacattgaaggtgtaaaaggtgttttctttgcacagggacagatgcagattattttgggaactggtgtggttaacaaagtatatgatgagtttattcggattgcaggagtttctgagagcagtaaagaagatttgaaaaaggttgcagcttccagagcaaatccggtacagagaatgatcaagacacttggagatatttttgtaccgatcattcctgcgattgttgcaagcggtttcctgatgggaatcatggaagcactgaacttcatggtaaacaatggattcctgaatattgataccagtggttcaatctatacatttgcacagcttttcagtaatacggcatatacgtttctgccgatcctgatcgcatacagcggtgctaaggtatttggagcaaatccatatctgggtgcggttatcggtatgatcatgattcatccgaacctgcagaatgcatggacagttgccacagaaggtgttaaggcaacgcagaaagtatggtttggactttattctgttgatatgattggatatcagggacatgtaatcccggttatcattgcagtgtgggtacttgctcagattgagaagcgacttcataaaattgtaccggcaatgtttgacctgtttgttacccctcttgtgagtgtatttgtaacaggatatctgactttatctattatcggaccaatttttgttgctgttgaaaatggacttctgaatggtattcagtggctgatcgcattgccatttggtgttggaagtttcattatgggagcgctttatgcaccaacggttgttgctggtgttcatcacatgtacacgatcattgaccttggacagatatccaagtttggagttacttattggctgcctcttgcatccgcagtgaatattgcacagggtggtgctgctcttgctgttgcattgaaaacgaaggatcagaagattaaatccatggctgtcccgtctgcattaagtgcgtgtatgggaattactgaacccgcaatctttggtgtaaatcttcgttttggaaaaccgtttgtaatgggatgtatcggtggtgcatttggtgcattgtttgcatctgttacaggactgggtgctacaggaactggcgtgaccggtatctttggaattttactctgtctgaataatccggtttcttatcttctgatgtttgtgattgcttttggcgtagcttttgtgcttacatggctgttcggatataagaatgtggcagcagataagagtactgtgataaataaagacgctaagtattctgaaagtactgaaagtgttgaaatcatcggagataaattggcaacagaaaaagataatctagatgatgctgtgctttacagtatatcagaaggaactgcgattttgctttcacaggtaaatgatgcgacatttgcatctgaagtgcttggaaagggagttgcggtaatcccatctaaaggcgaggttgttgctccatgtgatgcaacagttgagactatttttgatacaaaacatgcggttggattaagtacagaaaatggtatggaacttctcatccatattggaattaatacagtagaactggagggaaaatattatacagcgcatgtaaaagcaggcgaccatgtaaacaaaggtcagcttctaatctcttttgatatggataaaatcaaagatgcaggatatgatatgacgacccctcttatagtaactaattcagatgattataaagatgtgaaaattttgcaggaaggttctgtaacaccgtcagataaagtattggagattgtgaaatga

SEQ ID NO: 3261 - DNA, 1506 bp, Blautia sp.
atgaacagttacataaaaagtgaaaaagtgtcagcaaaaaagtatgaacaggagaagaggatgaacagaaaaatcacaaaaaaatttatgacctgtctgatggcggccacgattacagtgggatcatatgcatctccggtaatggcaaatccacactatgacaggcgtgatacagtagctgaagaggaaatggtaccggcagcaggaggcgcggctgcagataagggaagaagcaaagtaaatgctaaagcatggaagaagataaacggagtctgctataatggaagcggcaaagttatcccgggagctatcacaagaggaatagatgtttctgaatggcaggggaatattgactggacaaaggtaaagaaatcagacattgattttgcatttgtccgtatttcttatggtctgaatcattatgattatatttatgagtctaatatgataaaagcggaacaggcaggagtacctgtaggaacctatgtatacagtacggctttatctgctgaaacggcattaaaggaggcacagtatgcaattgagaaaatgcagggatataaagtctcctatccggttgtatttgatctggaatatgccaaagcaagtaatctttcaccaaaaaaagtttctcagatggcacttgccttctgcaatgaggtccgcaaggcgggatactatccaatggtatactgtaatacaaactggtatgataattatatagactggtctcttttatcgggaattgatgtatggatcgcaagatatggagatacaatccaggcaccggacaaagacagatataattatactatctggcaatgtacagatggaaatactgaaagcggactgaacagtaccagcggacttgtagccggaataccggcaggtaatgatgttgatgttaattttggatatgtagattatacaaaaaaagtcacaccgagaaaagaacaggcgtctgattatgttccatcaaaaaaaccagttgtttcaaacgggcaggataaaatagagagtggtctgtatgaagaagatgagaaatactatttcattgatgaagatggtgatcgtgtatcagataaatgggaaactataaatggcaaaacctattattttggcacagacggttatgctctcaaaggtatgaaaaaagtagacgggaagtattactggtttaacaaaaaatactgttatatgtatgaaaaccgccgggtgaccagagcaaatggagatatttactatttcggaagtgatggtgtcaggtatgagagcggaatgacgcaggtaaatgagaatggaaaagttcatacttattattttcagaaaaatggaaaagcatataaaggatggctgacactggaaggtaagaaatactatttctttaaaggcagttctgcagtttcaggaacacgtgccgagaacattacgctgaccagttccaggaaagtagtatctgtcttcaattccgcaggtgtctgcatgaaacagtataaaaagaaatag

SEQ ID NO: 3262 - DNA, 2442 bp, Blautia sp.
gtgaatacattggacaaagaagaatttcggataaaactggaagaaatcaataagctggttcaggataaagactataaaggggctatgagtattgttgacagtattgactggagacgtgtcaaaaatgtccgtactttatgtgttgttggtgaaatatatgcagcaaatggaagatatgaagacagtaaggagattttccttcttgcatatcataaagcatctgttggaaaaaatattctttatcgtctgattgaaatttctctgagaatggatgatatcagtgaagcagaagatttttttgaagaatacagacaggtggcttctaatgacaatacccagtatattctgcagtataagattgcaaaagcgaagaatgcatcactgaatgaacagatcagaattctggaagaatataaagagcaggaatttacagagaaatggtcttatgagctggctgctttatattataaagcaggagagaaacagaaatgtctggatttgtgtaatgaaatcattttatggttcagcgaaggaaagtatgtaatgaaatcctatgaccttaagatgagaatgggagaactgacaggcgcagagaaagcaaaatatgagaaacagtttattccgaaacttattacaccagaacaggcaaaggagcttaaaaaacaggaaacggaaagtgaatctgaacagcaggaagatgaaactgtaaaagagtccggagatagtaaagagcagactgaagaaattcagaaaatcgaagtaatggaagaatcagaagaaaaagctccggcgaaaccaattgatatggcgagtatgcaagctcagatttccaagaacattaaggatatttttggtggaaagtctttggagagggagaatttcacagaggaatcagtggatatgatcgatggagccggaattaccaaagaggatgagattccggaagaaatcataaaaagtgatgtttcagagaaagagccggaaaatgttccggagctggaagctgagccagagaaaccaggagaggcacctgtagctgttccggctgaaaataattcagaaaaggctcaggagaaagagaatcctgtagattttggtgcgacaataaagatgcctgaattaaatattcctgattctatgaaaaatatggaattaagtaaggcaccaaaggtagaagatgttgcaggttcttttgcttctgccagtatagactttaatctggaagatacaattctggcggcagcaaatgctcagggaattgagataccgaaagaggaaacagaagaagaaacacaaggagaagcactgcaaaattctgataaatccaatgaactggaagaacctgattttctcagcgaaaatataattgaggaatccgagccagatgaaactccgacagtagaggattatgtagaaaccggggagcctgtattgcaggaagaagaggaagttacagaagaagatctcagaagagcggaagcagaatttttgcatggacccgtggacaatgctgatctgaatctggaagatattgaggattcagatttagatactgaggaattagtttccgcacctgaagcggaaaatgaagaacctttatctgaagaagaagaactggagcgttttattgaatctattcagtcaaaagatgagacagatccaagaaatcttgtaccaagggaaaaagaactgactgatgatgagaaacaattgtttacatattttgtgaaagttccaggtatgaaggaacagttggttgatacattatgtgatgtgcagatggcggcagcagacaagacatccaaaacaggaaatatcattgttatgggtggaaaagaatgcggaaagacaagattgatttccggtctgattccggcaatatgcaaagaattaaatctggaagcatccaaggttgcttatgtttttgcagagcagataaatggtaaaaatatttacaaaatttttgcaaaactggcaggaggttttctggtgattgagaatgccaatcagctgactcaggaaactgttgagatgcttgataaggcaatggaagtaaatacggatggattgactgtaatcgtagaagatgaaaagattggtatgcgtaagttcattgccagatacccgaaatttgctaaaaagtttacttcgatgattaatattccggtatttacaaatgatgaacttgttaattttgcaaggatttatacgaaagaaaatggttatattatagatcagatgggaatgcttgcattatacaatttgatcggaattaatcagaaagaagatttaccaatgaacatcggtgctgtaaaagaaatgatagatgcagcaattgcgaagtcgcagggaggaattcgcaagtttaagcgaaatatatccaagaaacgtatagacagagacggctatattgtgctgtacgaaaaagattttaccaaataa

SEQ ID NO: 3263 - DNA, 1602 bp, Blautia sp.
atgagtgaattaaagcccgactctgaaaatacagaggagagacttccggaaactgtagagcaggaaaaagaacagtctgctgccagtgaggatgaggattttttttatgatgataatgatgcatatgaagcaaggagagctgccaggttggaacgccgtaataaggcacaccgcaggaggaaaagaatccgtattgcaggcagtgtgatcatagcagcagctgcggcagtgggaataggtattgggttttatggtgaagaactgcaaacatttttcacagaacagaaaacaaagatcacagagatggtggagtctgaagctaccccggcagctgtacagccggaacagaaaacagaagcagaatcagagaatactgccacacctgagccggaacaggaaacactgagcaaagaggataaggctctttatatgcaggcaaagcattatgctcagcagtatgattatgataaagctattgagattctcaagagcagtccgtcatataagacaaatacaaaattcaggaaagcggcaaaaaaatataaggagaaaaaagattcctgcgtttcctggccgttggatcaggtgacgcatgtgttttatcatacactgatcaaagatacctcaaaagcatttgacggtgattataaatcaggtgattatgatcaggttatgacaactatcgatgaatttaatcagatcacacagagtatgtatgataagggatatgttatggtcagtatctatgatatggctacggctgatgaaaatggaaatatgaacatgggtgaaatcctgctcccgccgggtaaagtgccgtttgtgctttcgcaggatgacgtatgttattatcattatatggacggcgatggatttgcttcgaagcttgttgtggatgaggaaggtaaggttcgcaatgagtatgtggaagatgatggaagtatttcaacaggagattacgatatggttcctctgatcgaccggtttgtggaagaacatcctgatttttcatacaggggagcaaaaggtattgtagcacttaccggatataatggtatccttggttatcgtacagacagcagctatgaaacccgtcctgatgatctggatgcggataaagtgaaatggctggatgaacatcctgactttgatctgaacacagaaagagagaacgcagccagggtagcacaggctatgaaggatgagggatggctgtttgcaagtcatacctggggtcatcagaatgtaagtcaggtcagtcttgaaagactgcaggcagatactcagaaatttaaagagaacgtggatcctctgatcggtgggacagatatcatcatttttgcgtttggggcagatcttacaggagctgaagattattcaggggagaagtttgaatatcttaagagtcagggatacaactattactgcaatgtggattccagtcagtattttgtacagatacgaagtaattacttccgacagggaagaagaaatctggacggatacagaatgtattataatcctgaactgctgacagatctgtttgatgcccagtcggtatttgattcatcaagacctgtgccggtacctgctatggggtga

SEQ ID NO: 3264 - DNA, 2730 bp, Blautia sp.
atgccctgtaggggagattacgagaagattaaggaagggagccttgtaatggcagcatcaaaaaataaaaagaccggacattcggggagaaatacgaaaaaagcgacagctatggagcaggaggtcggaagatttcagacagagattatagtgtttgtgattttggctgcatgtgtgatcttaatggcaagcaattttggagcaggtggttttgtaggagatgcgatcagtaatttctgttttgggttaatgggattgatggcatatttgtttccaatcgtgtttttcattggagcggcatttattctgatcaataaaaccaaccgtctggcatataagaagcttgcagcagcgtttgtaatgtttctgtttttgtgtggagcggcacagcttcttacagacggatatatgcagagtacaactttgatggattattatgcattaagtgcggactataagaccggcggtgggctgatcggaggtgcgatctgtatttccattacatctgcctttggtacggttggcggatatgtaatcattatactggcatttgttgtctgcatgatcattatcacacagcattctctgttggattttgtgacacttctggtcattaagatatgtgattttgtaaaagacggacgtacacggtatgtacagggacagcctgaacgcgagatgcgcagagaaaaacgtgcccgggaacgccagcttatgagagaacagcggcgtgaggaaaagatccgcagactggaggatgagatcggagatgatgaattttcggatgatgacgattttcttctggatccttcagaagcaaagaagatgaagaaaggcggatttctggaaggtaccaaactgacaggatattccgaagagaagccaaagaagaaggataagctcctgaaaaagaaaacagatactgccaaaatgacagcaaaaacagaagaaaatatagacgattccggcgataccgacaatacaaatgaagaatctgccgacaatacaggcaaaaagcaggaggaaaccgacggaaaatatgccggcactccaatgaattttgagattcacagggcagaggatacagtcacagatacatatgaggcagacagcgaaccacagcaggaagaggaggaagaactgctcccttttccggaggagaaggtgacacggcagccttcaaagaaccctaaatcttctgaaaaggagatacagagcggaattgtaaatattcagcatgagatcaccagacaggaagcagccgtaaaaaaagaatataaatttccgaccttaaatctgcttaagaaaggaagcaataaatcacagggagattctgatgcatatctgcgcaagacagcacagaagctgcaggaggtacttcacaatttcggagtgaatgtaactgttacaaatgtaagctgcggaccgacggttacccgttatgagcttcaaccggaaatgggcgtaaaagtcagtaagattgtcggtcttgccgatgacatcaagctgaatcttgcaactcctgatatccgtattgaagcaccaatcccgggtaaagcagcagtagggattgaggttcccaataaagagaacagtacagttatgctcagagatctgcttcagtcagaggaattccagaaggcaaaatcaaagctttcttttgctgtaggaaaggatatcgcaggcaagaccgtagttgcggatattgccaggatgcctcatcttctgatcgcaggtgcaaccggttccggtaaatcagtatgtatcaatacactgatcatcagtattctgtataaagcaaatccggatgaggtaaagcttatcatgattgaccctaaagtggtagaactgagcgtatataacgggattccccatctgtttatcccggttgtcacagatccgaagaaagcagccggagcattaaactgggctgtgcaggagatgacaaaccgttacaatacattcgcagagtatggtgtccgtaatctgaatgaatataacaaaaaagcagaacagatcagggaggccgggggagctgaagaagaacctgtaaagatgccgcagatcataattatcgtagatgagcttgcagatcttatgatggttgcgcccggtgaagtggaagatgcgatctgccgtctggctcagcttgcacgtgcggcaggtattcatctgatcatcgctacacagagaccgtctgtaaatgttattacaggtctgatcaaagccaatatgccttccagaattgctttctccgtgtcttccggtgtagattccagaacaattctggatatgaacggagccgaaaaattacttggaaaaggtgatatgcttttctatccccagggatatcagaaacctgcaagactgcagggggcttttgtgtccgatgatgaagtcagtgcggtggtagaatttcttgcagataagaatccgggagctcagtataaccagcagattgagcagcaggtaaattctccggtaaccgcagtgggtacgtccggagatgacagagatgtacatttcgaagaggcaggtaaatttatcatagagaaagagaaggcttctattggaatgctgcagagaatgtttaagatcggtttcaacagagcggcaagaattatggatcagctctgtgatgcaggagtagtgggaccggaagaaggaacgaaaccgagaaaagttctgatgtctatggaggagtttcaggattatctggaaaaccagtaa

SEQ ID NO: 3265 - DNA, 1497 bp, Blautia sp.
atggttacaggttactgttcattaaaaagtgtgtttttgatgaacgctatagaggaacagaagggagcagattacatgaacaatgaaaaagacctgggcgaaaaaccagataattccggtcaacagcccagatatgaacattatcagttccatgaagaacagggaactgttttgaagccatccaatccctccgaatacaaaagaaataaaaattcttttcagaagaaagcagggacaacggctgcacttgctgtgatttttggcctggttgcatcatttgtatttcagacggcgaattttacggcggacagattcctgaatagaggcaaatcttcggtacagattggaactacagacagtgtgggattgcaggagactgaatcagatgacagtacttctgataaaaccgtatctgagacagcttctgagaacggaacagtagcggcagtagctcagtcttctatgccttctgtagttgcgatcactaccgtgagtgttcaggaaataccaagtttttttgggtacagttctcatcagtacaagagtgcggcaaccggttcgggcatcattgtgggagataatgatgatgaacttctgatcgcaacgaataatcatgtggtagagggcgctacaactctgagtgtctggttttttggagatgatgtggcaaatgcagagactgagactgtgaatgcaggagacaatggagatctgaatgttgaggatgcggtcagtgccaagattaagggtacagatgctgataatgatctggcagttgttgcagtaaagaaatcagatattcctgaagatactttggaacagatcaagattgcacagataggaagctcggatgacctgacagtagggcagcaggtggtggcgatcggtaatgcgctgggatatggacagtctgtgacatcaggctggataagtgcattgaaccgttcgatttctactgatgacggaacgaacagtacagggctgatccagacggatgctgcgattaatccgggtaacagtggtggtgcacttctgaatatgaaaggtgaactgatcggtattaactctgcaaagtatgctgacagtgccgtggagggcatgggatatgccattccgatttccaaagcaaaaccaattctggaagaattaatgaaccgtgagaccagagagaaagttgacagcagtgaaaaaggatatctgggagttgtcctcgcaaatctgacttcagaggcaatccagatgtacaatatgccgaccggcgcttttgtacggggagtagaaaacgattctccggcgcaggagtgtggaatttgtaaaggtgatatcatcgtaaaatttgacggacagaaggtcagtgatggcgatgatctgctggataagctgcagtattataaatcaggagagaaaatagaagcagttgtggcaagagctaacaatggagaatatgaagaaaataccatagaactgactctcggtaccagaccggacaatgagtaa

SEQ ID NO: 3266 - DNA, 1743 bp, Blautia sp.
atgaaactttcagattatatcgttacttttttacagaaaaagggaatacgccatttctttggatatcagggaacaatgattgcccatgtggttgattccattgaaagaaatcctgatacagagaatcattccagctataatgaacagggagcggcctttgcggcatgcggttatgcccagacaaaagaggaatgtgcatgtgcatatgctaccagtggtccgggtgcagtaaatcttctgagcggcgtggcagatgcatattacgattcacttccggtagtcttccttacaggacagctaaacacatatgaatattcagggattgaaggattgcgtcagcagggatttcaggagacagatattgtagggatggcgaaaccaatcacaaaatatgcagtgcagatccgtaatcctgaggatattgtagtggaattaaataaagcttaccatattgcaacaacaggacgaaagggaccggttcttatagaccttcccatgaatatccagagaagcgaagtggagaatcctgtctatgatatgacttttgaggatgagcatacagatgctgccacagcgcagcaggcagcagatacgattcttgcagcactggaacaggcgaaacgtcctgtgatcatgctgggacacggcgtggacagttatgcaagccagcaggaactgatcgcttttgcgaaaaagagacagattccaattattactagtgttctggcaaaatctgtcctgggatatgagcatccactgaatttcggatgtatcggcggtgcttatggacatcgttatgcaaatatgattgccaatgcaaagagtgacctgcttctttgtttcggtatttccctgtgtaccagacagattggaacaaaagtgcatgaatttgcaaaagaggcaaaacttatccgtattgatattgatgcttataatcttcagagaaatatccatgagaatggagaaaatgaagtgaaacttcaggcagagacaggtgcggtcatcagttgtctggcaaaggcagcaggtccggaaaaagagggtgcaagtgagtggctcaatatctgcaatgagattaaagagaatcttcaggcagtagatgataatactcctgagagatatccaaaccgtatgatcgcagatctcagtgatatgctcagtgatacttctgctattgcagtggatgtaggacagcatatggtatggagctatcagtcattcaggaatcatgaaggccagaagcttctcttctccggtggtcacggagctatgggttatggacttccggcagctatcggggcatattatgctacaggaaagccaactgcatgtatttgcggagacggcgcattccagatgaatatacaggaactggaatgggtaaaaagagagaacattcctgtcaaaatgatggtaatgaacaatgaagctcttggtatgatccgtcatcttcagagagactacttcgactgcctgttcgcaggaaccacagatggctgtggatttgcttcctgtgactttacagaggtagcaaaggcttacggtattccggcactgagaatgcactgcgatgcagtcagagaagaggcaccggaatttatggaaggaaaaggtccgaaacttctggaagttatgctggagcatggaacctttgcatatcctaagacctgtctgggagagccaatccacaaccagcagccatatgcaccgaaagaagtttatgacagattgatggagttgtaa

SEQ ID NO: 3267 - DNA, 1476 bp, Blautia sp.
atgatatggaggattaaaatgaaattagtatccttgctagaaaagctggagtatacatgccttcagggcagtacagaccaggaagtaaagaatgttatttatgattcccggaaggtagaagagggttctctttttatctgtatccgtggcgcagtggtggatggtcataaatttgtgccggatgtagttgcaaaaggagcgaaggttctgatcgtggaggaagctgttgaggcaccggaggatgtgacagtcattcttgtgaaagatacccgatatgcgatggcatttatttctgccgcatatttcggtcatccggcagagaaactgaagacaatcggtattacaggaaccaaaggaaaaacaaccactacttatatggtaaagtccattctggagaatgccggatataaagtaggtctgatcggaaccattgaaacgatcattggtgataaagtaattccctcaaagaatacaacaccggagtcctatatgatccaggagtatttccacgagatggcggaagccggatgtgactgtgtggttatggaggtgtcttcccagggactgatgcttcacagaactcagggatttgtttttgattttggtatttttacaaatattgagccggatcatatcggaccaaatgaacataaagattttgatgattatctcagatgtaaatccttgcttctgaagcagtgtaaggtaggaattgtcaacagagatgacgagcattttgagaagattatcgaaggccatacctgcagtctggaaacttatgggttctcaccggaggctgatcttcgtgcagaagatgcaaaactggtcggaggtaaaggatatctgggtatttcctaccatctgaaaggacttctggattttcatgtggagattgatatcccaggtaaattcagtatttataattcgctgacagcaatcgcaatctgccgtcattttaaggtttccgaagagaatattctcaaagcactgagggttgccagggtaaagggccgtatcgaaatggtgaaagtatctgatgattttacccttatgatcgactatgcgcataatgccatggctctggagagtcttctgaccacgttgaaggagtatcatcctcacagactggtatgtctgtttggatgcggaggcaacagatcaaagctccgccgctatgagatgggggaagttgcggggaagcttgcggaccttacaatcatcacttctgacaacccaagagatgaagaacctcaggcgattatcgatgatattaagattggtatggcaaaaactgatggaaaatatgtggagatcgcagacagaaaagaagccattgcctatgcaatccatcatggggaaccgggagatatcatagttctggcaggaaagggtcatgaggattatcaggaaattaagggaaagaaatatccgatggatgaacgtgtcctgatcgcagatattcttgccggtaaatag

SEQ ID NO: 3268 - DNA, 1872 bp, Blautia sp.
atgattctggaaaagattaagaaacccaatgatatccataagataccattggaagatttcgagcctctggcagcggagataagagactttttaatccagtcagtaagtcagacaggcggacatctcgcctcgaatctgggagttgtggagctgacgctggctcttcataatgtgctggattttccggaagacaaactaatctgggatgtaggacatcaggcatatacacataagattcttaccggaagaaaagatgaatttaagaatctccggcaggagggcggattaagcggttttccaaagagaaaagagagtgactgtgatgcatatgatgcaggacacagttctaattcgatttcggcaggactgggatatgtgcgtgccagggatattctgggacagaagcattatgtggtttctgtaatcggagacggtgcccttaccggaggaatggcgtatgaggcattaaacaacgcagcagagctaaagacaaattttattattatcataaatgacaataacatgtctatttccagaaatgtagggggaatgtctacgtatctgagtgttcttcggaccgcagaggcttatacaggaatgaagctgggtgtgacaaagacactgaagaaggttccgaaggtagggacagctctggtggataccatgagaaaaaccaaaagcagtatcaagcagcttttcattccaggaatgctgtttgaaaacatggggctgacatatctgggacctgttgatggtcataatatgcgtcagatgatgaagctttttaacgaagcaaaacgggtagagggaccggtagtcgttcatgttctgacaaagaagggaaaaggatacgggcctgcaagtgcccatccggacagatttcatggaaccggaccttttgatattaaaacaggccgggcacttcagaggaaaacagtaccgagttatacagatgtcttttctcgaacgcttgtttttcttggcgagaagaataaaaaactgactgccattactgcagctatgccggatggaaccgggcttgtggaattttccagaagatttccggacagattttttgatgtgggaatcgcggaggaacatgcggtaagctttgcggcaggtctggctcttggcggtctgatccctgttgttgcgatttattcatcttttctgcagcgtgccgtagatcagattttgcatgatgtgtgtatgcagaatctgcatgtaatttttgccattgacagagcaggactggtaggggctgatggcgagacacatcagggttgttttgatttgtcttatctgtctatgatgccgaatatgacggttttggcaccgaagaatgacagagaactggaagagatgcttacatttgcagtaaactttgacggaccagttgcaatccgttatcccagaggtagtgcctatcagggaatgcaggagtatcagaagcctgtggaatacggcagaagtgaggttattcacagaggaaaacaagttgccgttctgggagtgggaagcatgattccgtcctgtgtggaaatctgtaaggaactgaaggaagacggctatgatcctacgtttgtaaatgccagatttgtgaaaccgctggatgtggaacttcttgatggactggcaaaggatcacagtttgtttgtgacagtagaagagaacgtgaaaagtggtggttacggagaacatgtatccgcttatatggaagcctgtcatccggaaacaagggtgttatcagcagcagtctgggatcgttttgtacctcagggaagtgtggacagtctgcgtaatcggattggtcttggtgtggaggatatcagacaggcaatagaagatagtgaggaattaaaagaacaatga

SEQ ID NO: 3269 - DNA, 2184 bp, Blautia sp.
atgaaaaaaaagctggcaatgctatttggaatagtattactggctttagtaatattaatactgagaattacttatattaatgctaccagcggcagcaaatataagaagcaggtattaagccaggcgcaacagaaatatgaaagccaggtattgcctgccaaaagaggcgatatttatgataaaaatggaaatatactggctaccagtaacaaggtttacaatgtaatactggactgcaaaacagtaaattcggatgaggattatgtggagccgacgatcagggcattaaatgaagtgttgggaattgatgaagaaacagtccgttctcttctgtcagattcaagaaccagccagagccagtatcagatactgataaaacaactgtccatggaaaaaaagaaagaatttgataaatataaggcagaggacgaagattccggactgacgaaagcccaggcaaaggaacgggcaaatatcaaaggtgtctggtttgaagaggattatctgagaagttatccatttaatgaaaccgcatgtgatacgattggatttgctctggacagagatgtggcagacagcggactggaagggtattataacagtacactgacaggtgtggatggaagacagtatggttatattaatgacgattcggatgtagagcagactattattgctgcggcaaatggaaaaagtattcagaccagcattgatatcggcgcgcagcagatcgtggagaaatatgtaaatggatttacagaggcaatgggtgccaagaatataggagtcattgttgaggatccgtctacgggtgagattattgcaatggatggcggcgaccgctatgatctgaataatcccagagatttatcaaatttatattcagaagatgaaatcaaagcaatgaatgatgtggaaacagtagaagccctgaatggtatgtggagtaatttctgtgtcacagatgcctatgagccgggatctgttgtaaagccgatcgttatggcttcagcactggagaaaggtgcaatacaggaaacggatacatttgtatgcgatggtgcccagactttcggagatacgatgatcaagtgtgcggtttatccaagtgcgcatggtacagagacactgggggaagtaatcgcaaactcctgtaatgatgcgatgatgcagattggtgcaaagatgggggcaacacagttcatcaaggcacagagtctgtttaatttcggaacaaggacaggaatcgacctgccgaatgagggcgcgggtattattcatacgaaagattccatgggagaaacagaactggcatgttcagcttttggacagggtttcacctgtactatgattcaggaaatcaatgcaatgagttctgttatcaatggcggatattattatcagccacatcttgtgacaaagattctggacagcaatggcggaactgtaaaaacaatttccccgatacttctgaaacagacgatttcatccagaatttccagtgatatcagaagttacatggcgttgagtgtacagcagggtaccagtcgtcattccaaggtacagggttacagttctggtggtaaaacaggtacagcggagaaatatcctcgaggaaatggaaaatatctggtttcctttatcgggttcgcacctgtagatgatccggctgtagtgatctatgtggttgtagatgaaccgaatgtagagaatcaggcaaacagtacttatccacagtatattgcacagggaatcctttctgagcttctgccttatctgaatgtaacgccggatgaatctgatgatggaacagtaccggaaacggaactgtgggaagggtttaaggggcacttaaagagtatttccatatcagacagtgaacttgacagcaatggcaatctggtagatgcggatggcaatctgattgactgggatggaaaccggattgatgaaaacggatatctgctggatgccaacggagatcacatactggatgaggagggcaattataagatgtctaccaatctggtcagtgcagcaggaagtacggatacagattcatcgggagatgcggtatccaatccggatgcacctgcgcctctggaggatgatgaagctgagacaactgaagataataatgcagagacagagggcattaccaatgaggaagccggtctggaataa

SEQ ID NO: 3270 - DNA, 1893 bp, Blautia sp.
atgagtaagaaacaatcagcaggaggaaagattcagtggacgagaatgctgaagaaactttctccctatacgatccagaaaggatttcgttatctgaagcactatggtccgaaagaattctggatcaggcttcatgaacgttttgagccggaagaaataccgtatggtccatggtatgcggcatatattccggataaagaaacactggaagcacagaagaaacagaaatttgcctggtcaccactgatcagtattgcagtacctgcatatcagacacctgtggaatttctcaggcagatgattgaatcactgattgcccagacttatggagaatgggaattatgcattgcaaatgcaagccctgacaatgaggagatgcagcgggtgctggcagattactcagcccgggatccgcgtgtgagatttcataatttaaaagagaaccttgggattgctgagaatactaacagggctcttgctatggcgaagggagaatttacaggtctccttgatcatgatgatcttctggctccgaatgcactgtatgaggttgtaaaagcattgcaggagcatccgctggcggatgtattatatacggatgaagataaagttacgacagaactggacgaacattttcagcctcatctgaaaccggatttcaaccttgatctgctccgttccaataattatatctgtcatttctttgttgtacgcagcagtattgtggagaaaactggcggattccgaagggaatttgatggcgctcaggactatgatttcatttttcgctgcacagagaatgccagagaagtggtgcatgttccggaaatcctttatcactggagaacacacaaggcatccactgcagataaccctgccagtaagatgtatgcttttgaagccggtaagagagcgatagaggcgaatcttctgagaaccggtacaaagggtgtagtaagccatacacaggatctgggattttatcgcgtgaaatatccggtgcagggacagccgttagtttctgtgatcattccaaacaaagatgagaaggaaactcttcagacctgtctggaaatgctggagaagaatacttcctaccggaattttgagattattatcattgagaataacagcactactgaagaaatcttcaaatattacaaagaactctcatctgatccaaggatccgccttctgcgatgggggaaggaatttaattattctgcgattaataattttggtgcttcccatgcaaggggagaatacctgttgtttctgaataatgatgtaaaatccattaatccggactggatggaagaaatgctgggtgtgtgccagcgtccggaagttggcggagttggtgcgaagcttatatacccggataatacgatccaacatgcaggctgtgtgatcggaatgggcgggattgcaggacatatgtttgttgatatgcctgcagaccgtaccggctatctccataaagcatcccttttgcaggatatgagcgcagttacggcagcgtgtctgatgatgaagaaggaagtttttgaggaggcaggcggatttaccgaagaactggcagtggcatttaatgatgttgatctgtgcctgaaagtaagaaagagtaagcatctgatcgtatatgatccgtatgcgaagctttatcatatggaatcgaaaacccggggtgctgaggacagtgtggaaaaagtacgccgttttcagacagagatagaatatatgcgctgtcattggattgatattcttaagaatggagatccatactataataaaaacctttctctcgccaagtggaattactctctgaaaccgattccgggaatggaaacagcagaagatggacagaagaaagagaaaacggggaggaaataa

SEQ ID NO: 3271 - DNA, 1014 bp, Blautia sp.
atgaaaaggaaaaagctacactccaaaagcctgctggcatttatgttcctttgcatctttatcatgtgtgcaagtgtaacagtatcagccggcacaaacatcctgccttctgttaaacaggcaaaggcaggcacctggcagagagacgagaacggcaacaaatatgtgtatacagatggccgctctcccaaatcctgctggctgaaaatcgccggaaaatattacagctttaattcccagggatatgccgaaacaggatggaagacttataacggagaaacatatttcctctctgaatccaaatccagaaatggacaacttatgaaagggcttcgcacaatcagtaataaaacctattacttttcaaaaaccaccggtcagttatcacatggctggcagaaaatcggcggcaaacgttattatttccatcccaaaacaggtgccatggttaagaaaaaatggattggaagccgttatgtatcatcaaccggtgctgtcacaaaggtaaaacggacttcaaaatcccgcctgatcattctgggagactgccgtgttgcttccatgcgtgaatgtggaatcggaaatgcaatttatatcggaaaagtttccatgggatatgactggcttagatccactgccggtcctatgctggaatcttatctggcatcctacccggaatccacggtagtgtttggtttcggtctgaacgattacctttatcagcaggcaaaatatatcgcctattatcgttcctttattgccagtcacccaaatgcaaacatctatctgatgtcaatcaatcccgtgattggagttggtgcttataatgtaagcaacgccacgatcagaccttttaacgatgcattaagaaagaacttcccggattattacctggactgtttcagccacctgcagaaggttggttattatgcagcagacggtcagcattacaacacagctacctaccgcaaaatctataactatatcgtaaaagctaccggctggatatcctga

SEQ ID NO: 3272 - DNA, 1491 bp, Blautia sp.
atgaaggaaaagtttttgaaaagaaaatggctcagggttctggctgcggtatgtatgtcggtgatgctgctcctgagcatggtgcagggagcttttgcagcggaggacagcggaaggactaccggaagcctgtcactgactctggcggttacggaggatggagagcaggttcctctgaccggtgtgccccttgccttgtatcaggtggcagatatggacacagagccggtggtgtatttccatctggcatcttctcttgcaggtgcaggtgtggatctgaataatctgaagactgcggcggatgcggagaatgcttcgaaggttcttgccaataaggttggcggtgtggggatcgtgcctctcacaggagtgactgacggggagggaaagctgttctttggttctctgccaaagggtgtttatctgctggtgcagaccggtgcgattgatgagtgcagggtttctcctatgctggtttccgtgccttatacagaggacgggaagaagtttgagtatgatgtgcaggcttttcctaaggcagagaagacagataagtccaagaatggaagtctgacggttaccaagaagcttcaggctattgataatgataccatggatttcgtggatatctgtgctgcagatgccacttattatgtaaggcttttccttgatgagtctgcgacgattccttacggggatgtgaagtcgatacatattcaggggcagaacagtggaagcgtggattattcggatctgcccacaggtacttattatctgcgtgagactgatgcacagggtaatccaaggccattggatgacagcttcgtggatgatacaggcgtggaagtgaactgtatgatccaggtaaacggagaggattctacaagcattacctttgacccgtctgcggatcatttcgatacgcaggaggctgtggtagataatatttatgttaagattccggatggcttctacatggagagacagttgaatattgagaagaaggttctgaaggatggtgttgtgactacttcggatcagactttctatgcaactgtgaatgaggtggatcctgcgaccggtgaggagaccacggtgatcacgactgagctgaagcagaatgatacggttacggttcttttccaggtggcagatatttcggataaggatgtggttcatacctacagagtctttgagtctgacgcagagggtaatccggttaataagagtacctttggttttgcggtaagtggtgagggtaatgtaagcttcacaggtactgaggttgagaagtctataacgatcaccaacacagtggttacgactacaccgggagtgacaccgggagtgacaccggatgttcctggtggtccatcaattccgcataaggttaagacaggggataacacaccgatcgtgatgtggatcgtggttctggctgtggctgcagcggtggttggatttgtggttgtacgcaaaaagaagaaatag

SEQ ID NO: 3273 - DNA, 1884 bp, Blautia sp.
atgaaaaaaagaatatggaatcagttaaaaaaagcagcaatgatgactgctgctatcgggatgttgggaaccggtgcggcatctgctgctgaattcggagaaacagaattgtccgtgcctgccgtaagtttaagagagtatgcagaatggattgatgaggagaattttcaggcagaacttacactggaagtgagtggcctgaaagaactgtataaaaaagaatatgagaatccgaatccggagaatgtacatgggcagacagaaaaaacggatgtatcagcagaggagaatgcagatgtggcatcagtggaaaatatggaatataaagcagaaaccggggatacggaaagcagatcagagaatatagcggtgaatgaggaaggagaagaatatcacaacgcagaagagaatataaaaggtgaagaataccagaatgtggaaaaaaatgtgggagaagaatatcggactgaaggagaaaatgcggaagaaaatgaaaatcaggttacaggagaacagattacagaaaaagaagaaaaaacagtaagatccaatacagagatcagcagatattttctgacagcatacatttcagaatattttcaggtaaaggaagatgatctgaaacatgatatgcaggcagagtctgtgcagatacaaaatcagaaaggtgagataacccagattacaaagctgacctgtgaggtgctgcttccggatgcggaaacagatgttttcagtttgaaggtaccgatatctctcagggaagaatatcgtatctctcctgtacaagtggattatccactgtgccaggacacaccgctttataaagatcaggatggttcaggagcatatgtctggatgaaagcgggggaagaggttcagacaatggcggtatctccttctgctttactttctgtacaggaagcaaaaacaggaattgcagctcaattgcagcaggaaacaaaagaggcgcgtgcaggacaggaactggtctatatactgtcagtacaaaatacaggagatttgtcactggaaaatatagagatatccggtactttttctgaaagcggtatgaaagccggatggaagcaggaagagggatttacagtaaatggtatgcagggaatcatctcctgtcttaaggccggagaaatcaggcaggttcggatgatagtggagccgacagaagaacagactggagaaattatcaatactgtaactgtgaaagtgaaatatccgggaaaagaagaaaatattgaatgccagaaatctgtcaaaacagagataactgcattaaaggccgcctttgaggtggagaaaacggcagacagaacacaggcatatccgggggatacgattacatatcagatctgtatccgaaatacaggcgagcggacactgcattcggttttaagcacggaaagattccggaatgccggaatacaggcaaaatttgtccagaaagaaggtgtgacattaaacagtagcggtacgcaggcactgattccacagattgcaccgggagaggcatttgtactctatgcaacagtgacggttcctcaatatcaggcaagtcaggaattggtcaatgaggtaacagttacttcgaatgaaaccggctcacaggcaatcacatctcaggcaaatgtaaaactgaccggaaatgataatactgttacagtcacaccacagcctacgtctgcacctgtggcggttcagagttatggatatgagtcaaagtccggaaatgcctatactgctgcttccaagccgcgtacaggagacgaaacggaaacagctttgtatattgtgctgggaatttttgccattatgtccggagtcagcgcattctgttatatgaaaacaaaaaaacatcagaagtag

SEQ ID NO: 3274 - DNA, 2274 bp, Blautia sp.
atgactgaaaaacagaaatatctcctgaaactttttcgggaagttgatgaaatatgcagagagcataatctcagatatgttctggcaggagggtctctgattggagccctcagacatgagggatttgttccatgggatgatgacgtggatctctatatgccacgtccggactgggagaaattcgtagagatatgcaagacagaactgccgccggagagagctatccagtgctcagatgtggatagaaattatacgaattcatttccgcgttatgcatctaccgatacctgcgcgatccataagagccagatcatcggcagagactgtggaggtgagatcatagatattcttacgctggatcctattcctgctgatgacagagaatatgagaaataccggacacatatgatgatctattctgatcttatcaatccctcggtagtatacagtgaccgttgggagataccggtatctatgtatctgaaatatcttctttcctatatctttctgggaaagaacagaacactggaaaaactggagaagatcatgttctcttacaaagaggaagaatgcgacagatatgcaatgcgttggggcggatgcccctttctgtttgacaaggacatgatgtttcctgttaaagagggaatctttgaaggacagaaggcaatgatcccgaataaatgcagtgattatcttatctggcattatggggatgaatgggcttatatgcctccccatgacagcagggaaggacatgtggctgtgtgtctggacagtggatcttatcaggaattgcgtgatgattacatgccgaatatcagaaaaggcagactgcgcagagaatctgtattccgtaagatctacaatatacgaactgcgaaaaagagatacaaggtgcgccaggagggacttgccatgaaagcccacacagtttcatgggacctaaaagagaccatcagcgagtccggactgaaaatcagtgagcttgtagaacggaaagatttccacaggctaagtgcattgtttggttcttattacaaaaatcagctaagtgcggattttatcggaagagaagactatgcaaatatttatgcattttatcatccaatccttgtggatgtggaggatgatgtattttatgcggcaatgctgactcttttttatacagagcgggtatcaaaggcatatcgtatgctggaagtgcgtgagaaactggatcatatcacacctgagatggaggagctgagaaaggatattgatcttttcagaaaagcagcagatcattatgaattccgccgcatgaaggaggcagaactgatatgtggagatttgctgaaaaaatatccgggtcatccgggtctgataaaattcagatgtcggtttctgatggagagagccggagaaaaccgtctggaagcggaacgtttcctggaaaaagcactgaaactgttcccggaggatggatattttctgaaatacaaagctgatattctctggatgaatggagaaatccagaaggcaacacaactttatgtgcaggtgaaggagaagacttccaacgggattgtatggctggagatggacagagtattcagaaaatacaaaacagaagtcctcagaaagtgtgaagagcttctgtcgaagaaatccagagaagaagcactgcagttgatggaactgtggagacagctcataccggaagacgaagaagtccagggcgcatggtatctggcaaaagtagcatgtgctcatacgcagagtgaagtagaagaagagatagctgaaatctgtgaggtgatagaaacaccaatgcttacttcgacaccgaagaccggagagtatacaatgtacagaaaggcacttaccagagcatggaagcgcctgggatatcctgcagaactggcgaagctgcgtactcagactatatgtaccagtgatgaaagtgagttggaatggctttctgagcaggtgcgcagccggcagatccacagagaagaatgtgtctgggcttataagctgatcggggatatccgtaagaaacaggggcagacaagagaagcctttgccaattataagaaggttctggattatgagatgccattgtatctgaagacggagatgtatcgtatctatatcagtgacctgactgaaggaagcgaacgaatcacaaactttgcaaagaaagctgatgttacaactgcatttaacagttggctggacaaatacggaagtatagaagatattaaggcactggtaaacagacttgtctga

SEQ ID NO: 3275 - DNA, 2148 bp, Blautia sp.
atgggaggatataaaatgaggaaaaaacagctttttgcattattaatggcaggtgcattatctgtgggtatggcaccgacagccgcatttgcggcagaagataccgcagttgaggaaacttcaggagaacttgaaacaacagatacagaaacacctgcggaagatactgcaatggaacctgccggagaaacacctgcagaagaaccttcagagacacctgcagcagaagaaccggcttcagaggagcctgccggagaatcacctgaagcagagcccacagaggcacctgcagcagagaaaacagatggggcagctattgtagtcggagaaaacacttatggaacacttgcagaagcatttgcagcaattgctgacagtgcagatatgagtggaacacctgactatatcaaagtaaaaggtgatattgagatcaatgcttccattgatgttccggctaataagaatattatgcttgttgcagcagaggataccactatcaaacgtgcggcaggatttacaggcagtatgtttactgtaagcggcggctctctgcagatggccggaggttctgtaactgatgcaaatggaactgctttaggatccggcagtttaactgttgacggatccggcgatggcgttaccggttctgtcgtggaagtatcaggcggcaactatgcgctgaccgacggggcaactcttacaggaaataacacaacaggagatggtgctgcaatcaataatgcagcaggtgcaaatgtgtatattctgggaggtacaattaccggaaatactacaacaggcaatggcggtgcgatcaataacgcagcaggtgcaaacgtatatcttcagggcggcacgatcacagcaaactctgctgcagcaggcggtgccatttacagtgaaggaactgtaaatatcaaaggaacagtaagtgttaccggaaatacagttaccaattctttcccggaggctacaagcaaccttgtacttgacaaagaaggtgtgatcaatgtaaccggtgctgttacagattctgcgatcggagttgctgttcaggaagcagaagcaggccgaactgtagtaaaactggacgataatgttactgatgtgaagctggcagatgttctttctcagattacatatgagggagactccagcctgaaacttggcgaggatggaaaactgtccggcacagcagaaccgagtgctacaccgactcctgcggaagcgaagctcaaagttacaggaaaagaatgcaagtggtccggaaacagtactgttaaaattaaatttcagtctaatgtaaaaggtacttattatatcgactgggtaaaacgtggtgagaaggcaccgacaatcgatacttctatggtgggagctccgattgatgctgataccaatgtgacagcaaaggtaacagatctccctgattatgatgttgatatttatgtatgtgtagtaagtgataaggataagagtaattatggttctgtaatgttccagcctgagtcaaaagaacgtcctgttacacctacaccgtctcatactgcggttgtaccgaatgtaaatgagagcgttgtacagggatttgagaatgctcttgtattctatccaaatacattctatgatttcaaggtaattggagcaggtacacagaacagtaaccctggtgagggagatgtaagatgggttccggcaggatggagcatgtcttctaatccgtcatcctggaatacatcctggaagattggcgcaaagagtggtatttatacagatacagagaaagcgtatacaatctatatcagatatgacaaacaggtatacagcggtaatgactggcagagcacagatgcttctgaagttctgtcctatcagttcaaggcagcacctctgtcaccgacagcaaccacaacaccgggagcaaacggtacaagtggtgacggaacaggttcaggtgatggaactacaacagacggaggaactacagatgtaactccgacaacctatgcagacggaacaaatggaacagcgagatcagcggtatccacaggtgacgaatcaccgatcggaacaatgctggctctggcagcagcttctgttctggcaggtggttatgtacttatcagaagacgtaaaaaagaaatgtaa

SEQ ID NO: 3276 - DNA, 1941 bp, Unknown
  Description of Unknown: Erysipelotrichaceae sequence
gttcttacagaagagattgaagggaatgctttatatttgtgtgattcaaaaggacatttgatttatgccaaaaccccttggaataaaccatcagaaaaacttgatgaatatgcacataccttatttgataatgtacagaaggggtatttctcctcttatgatgacagttttaaagattttaataatgaaagaagaggagtctattattcacagatggaaaatggctggatgatcattatgacgattccttttgatacgttgctgctgggggaaagcaatgtattaatgtatggacttcttgctgttggaggcattttaatactgattcttttgtttatgtttgtacgagatatcctgcatagcagaaaaataaaagaagcagatagaacggtatctatactttctgattctttttatgcgatttatcgagtaaatttgaaaacaggaatgtatacaacattaaaaaatgctgcagatatggatgaaaaagttggaatgaatgggacgtatgatcatttactgcaaatgattgagacagtcgtagaaaaaggaacgtatcaggaatttgcattttgtttttctttagacagcataaaacagcgagtgaaggaacatattgcggattatgggggagattataagcgaagatttaatgatcgttataaatgggtaaatatacgaactttatataacgaaaaaatatccagtgaagaagttattctatgtttccgtgatgtggatgtagaaaagcgacaagagctgcaatatactttgctgctgcaggaaaccttggaaacaaataaaaagtcagcagaagctaaagaaaccttctttagcaatatgtcacatgaaatgagaactcctttaaatgcgattattggattttcaaaactggcacttgaaagcggagatatgtcagataagaacaaagagtatataaaaaagatttctttttccggacaaaatatgctgtctttgatcaatgatatattggaactatcaagattagaggcagggcattcccgtttagattatagagactttaatcttgaggaatgtatccataatatcagcggcagctttgaagcaaaagcaatggaagataaaaaagattttaaagtaaacattgatattaaaaacaaatatataaaaggagatgaactaaaggtagttcaaattttaaacaacttattgtcaaatgcctttaaatacagtgatgcaggggataaagtcttattagaagtaaaagaactggaatatcgccagtatcataaaattcgctttacgatcaaagacagcggtattggcatgtctgcatctttcttaaatcatttatttgaaccttacgcaagagaaacacacttttccacaaaatctacgattggaactggactaggaatgccgattgtaaaaagtttggtagaacagatgagtggggaaattgaagtagaaagcaaattgaaagaaggaacgacttttgttgttacacttccttttgaagttgcaaatgcccaggtcagtgaagaaaagaaagatgagaagcaaacagaaaatgttttacaagggaaaaaagtacttcttgcggaagataatgaattaaatagagagattgcaacggaaatattacaaatgcatgatttgaaagttatttgtgcagaaaatgggaaagaagcgctggatatctttcagtcatcttctccatacagctttgatttaatattgatggatatgcagatgccaatcatggatggatgtgaagcaagtgaaaagatacgtagtctggatcgtgatgatgctagaagtattccaatcattgcagttaccgcaaatgcttttagtgaagatgtcgcaagagttttacgttctggtatgaatgcacatatcgcaaaaccaattgattttaacgtattgcaggaagtaatgaaagcacatctgaaatga

SEQ ID NO: 3277 - DNA, 1014 bp, Unknown
  Description of Unknown: Erysipelotrichaceae sequence
gtggaggaacgtttactagcaaatacttctcaaattcaggatgaagaagatactcttcgtccgcagtcattaaaagaatatattggacaatcccagttaaaagaaaacttatcagtttttattgaagctgccaagcagcgtaatgaagcacttgatcatgtgcttttatatggccctccaggacttggaaaaacaacgctttcgtatattcttgcgaatgaaatgggtggaaaaattcgtactactagtgggccaagtattgaaaaaagcggtgatcttgcggcaattttgtctactttggaagcaggagatgttttgtttattgatgaaattcatcgtcttcccaaacaggtggaggagattttatatccggcaatggaagattactgcattgatatcgtggtaggaaaagatgcaggaacaacacgttccattcgtctagatcttcctccttttacacttgtaggggcaacaacacgtgcaggggatttaacggcacctttacgcgatcgttttggaatcgtttctcagcttgagttttattctatgcaggaacttcagcaaatcatcacacgtaccgcacgtgtcatggatactggaattgatgatgaagcagtacttgaaattgctttgcgctctagaggaacaccgcgtatagcaaaccgtttgtttcgtcgtgtacgtgattttgcgcaggttatgaacgatggatttatatccaaagaaattgcctgtatggcactagataagcttaaagtagatcatttgggtctagataatgttgatcataaatatctaaaaggtattattgagcgctttaaaggtggacctgttggtttagaagcattagctagcagtataggagaagaagcgatgacattagaagatgtgtatgagccatatcttcttcaaattggttttatcaatcgtacacctagaggaagaattgttacagaaaaggcatatcgtcatttaggctatgatgtaaatgaaggactattcaaaatggattag

SEQ ID NO: 3278 - DNA, 1236 bp, Unknown
  Description of Unknown: Erysipelotrichaceae sequence
ttgcgtattaaaaatatagtaatcacagcaaaaatgccaaaaaagtatgattttgcgattcactttacggtattggtattattattgtttggaactttaatgattgtttctacaacagtaggaaatgcaagtagtgtcctttccattattattgcctttgttaaacaggcagtgtttctggttgtttcttatacactaatggttttgctggcgaataattttaccatgcaaaaagcccaaaaatggcttgtaccaatttttgttggcttaatggcagcgatgatagctacgcagttttttcctgatgtatatggttctaaggcatggattcgaataccacttggttttacgcaggtaactttgcagccatcagagtttgttaaaacttttatggttgtcgtattagcagtttatgttgaaatttatgcaaggcgcaattataaatggacaactgtcatgcgtattccaatcatctttttactaagctttattttaatgattttcattcaaaaagatataggaacattagcagttatgttatccatggtaggggtttgctttttgataccgagtcataaaaatcttcgaaaaccgcaaaagattttgcttatactgatttgtacaggaattggcttgcttttatttttaatgagtgagccgggaatggaagttgttcgatggtttggtgaaaaatttccatattttgctcatatcactacgcgttttgaaaatgccattaacccttttttagacccatatgtgggcggttatcagccaatcaatggattgtatggaatcgcacgaggaggtttacagggggttggatttggggagtctattcaaaaatatggatacctgacacaatcggataatgattatattttatcaattgtaattgaggaactaggggtttttggtttaggaatcattgttgcaggatatgcaatcattatcaaacgtttattttattatgcatttcgtacaaaaagtgaagggtataaggttattcttattggaacagctatgtatatctttgctcattttgtgttaaatgttggtggtgtaggaggtttgataccattaacaggtgtgccattgctgtttatttccagtggtggaagttccatgatgtcaatcatgtctgctataggaatatcacaggcaattatcgcccgtattcgaagacagggtacgatacagaaaaaaattaaatataaaaaagagcctcaaaactga

SEQ ID NO: 3279 - DNA, 1311 bp, Unknown
  Description of Unknown: Erysipelotrichaceae sequence
atgattagtggtattttagcaatagtaggtcgtccaaatgttggtaaatctacgatttttaatcgtattataggggaaagaaaaagtatcgttgaggatatcccaggagtaactcgtgatcgtatttatggaaaagcagaatggcttacaaaggaatttcgagtaattgatacgggtggtattcagcttgcagatcagccttttcgtgatgaaatcaatatgcaggtagaaattgcaattgatgaagcggatgtgattttatttgtagtcagtggtaaagatggaattacgatggatgatgagtatattgccagacttcttcaaaaatccagaaaaccaatcgttttggctgtaaataaagtggatgatttttcacagaatgatgcaatttatgagttctataacttaggtcttggagatccgattgcagtttctgcagcgcatggtattggtactggcgatatgctggatgaaatcgttaaggcttttccggataagcagcaaaaagaatatgagggtatgactcgtttctgtctaataggtagaccaaatgttgggaaaagttccttagtaaatgcaatattaaatcaggaacgtgttattgtatcagatattgagggaacaacacgtgatgccattgatacgccttttaaacgtgaaggaaaagattatgttgttattgatacagcaggaatacgtaaaaaaggaaaagtctatgaaaatatagaaaaatactctgttttacgtgctatggcagcaattgaaagaagtgatgttgttcttgtagtaattgatggagaaacaggtattcgcgatcaggataaacatgtggcaggatatgcacatgaagctggaaaaggggtcatcattgtttataacaaatgggatgctgtagacaaagatgagcagacgatgcagaaaatcgaaaaagaaattcgtgcacagttcctatatctaagctatgcaccaatattatttgtatctgcgcttaaaaaacagcgtatccatacacttcttccggcaattgatgaagtgcatgattattcagttcttcgtattcagacaaacgtattgaatgaagtaattatggatgcacagttaatgacaccacctcctacacataaaggaaaacgattaaaaatttattatgcatctcaggtatcggtagcacctcctacaattgtgttatttgtaaatgacccagaattgctgcatttcagttataaacgttacctggaaaactgtttgcgtgatgcatttgcctttacaggaacgacaattcgtatcctggcaagagaaagaaatagataa

SEQ ID NO: 3280 - DNA, 897 bp, Unknown
  Description of Unknown: Erysipelotrichaceae sequence
atgaaagataaaagaggtgaaagaatgatagaaaatacagaattgggtagtgcagttgaaattagaggaaaaggaaaggcgtttgatgattactgtaaaagagtattgtcaaataaagatgtagtaagttatatacttgaaaaacttatcttagataacaagggatattgcggtataaaagaaagcaatatcgtagatgaaagcataccaggtgcaagaatagagtatgataaactctatgaagtaaaacttcctaaaacgaagatatttgtaaacatagaagcacaaagcaaagaaaatccagggtatccattgatgaacagagcagtttattatgtgagtaggttgatagctaaacaaaagaataagtcagaagggtttatgaaatcaaggtatggagaaatgaaagaagtgtattccatatggatcgtaatggatatggatgtgaaaaaagaggaaatgatagaagtacatacatttcctgaaaaagaggataagacattgatgaatatcattatggtatatccattaaaagaagacagtgaaaatgaagtcatcagatttttacacattttatttgtatcggatatggaagtagctaagaaaaagcagatattagaagaaagatataaaataaaaatgacaagagaactagaggaggcaatggatgatatgtgtaatgtaattgaatattatgaaagaaagacaagagtagaggcattggcagaagggaaagaagcaggtatagttgaaggagaagtaaatacaatgctcaaggctatagaaaaaatagaaaaaaatatgaatttgagcagagaagaagcaatggagattttagagattgatgaagaattaaaaactaagattttagataggttaaacagaaggaaatcataa

SEQ ID NO: 3281 - DNA, 1149 bp, Unknown
  Description of Unknown: Erysipelotrichaceae sequence
atgagtacaattattgcaggttgtggctttggcggagcagttgtagcaagacagctggcagaagcaaatgaaaaagtaagaattatagaaagaagaaatcatatcggtggaaactgctatgatgaaatggatgcttatggaattttggtacatacgtatggaccacatatatttcatacaaagataaaagaggtatatgagtatttatcacgttttacgaagtggtatccataccagcatgaagtagtagcgaatattcatggaaatatggtgccggttccttttaatctgcattcaattgatatggtgtttgaaaaagaaaaagcacagcgaatgcgctcagttttattaaaggagtatggagaaaatgcacgtattcctatattacagttaaggcagcatgaaaataaagaaattcaggaacttggtaattatgtatatgaaaatgtatttttgaaatatacgatgaaacaatggaatcaaagaccagaagaagtagatcaaagtgtaactgccagagtaccggtgttaataagtgaggatgatcgctattttcaagacccatggcagggaatgcctaaagaaggttatacgaaattatttgagaatcttttagatcatccaaatattgaagtagaacttggaaaagatattcgagatattatggaatttgatttcgataagaaaaaaatttatatagataaaaaagaatttagtggtaatatcatttatactggtatggtagatgaactgttagcttataaactgggacatcttccttatcgttctttaaaatttgattttgaacataaagatatggaatactatcaaagcaaaggcgttgttaattatacggtgagtgaagactatacgcgtatcacagaatgcaaatatttgactggacagaagtgtccatctacaacaattattaaagaatatccaagtgcttataaagcaggagaaagtgaaccatattatgctattttaagcgaagagaataaagcacttcataaacaatatgaagatgtattatcagattttgataatttctatctgcttggaagacttgcacagtatcgttattatgatatggatgccattgtgaaagaagcgttggatttagcagaaaagttaaagggtgaaagataa

SEQ ID NO: 3282 - DNA, 855 bp, Unknown
  Description of Unknown: Erysipelotrichaceae sequence
atgacaacatctaccaaaaactactcagatagcataaaaagacttaaacaggaaatcaaaaatgcggatgcagttttggttggtgcaggagcaggactttccacttcggcaggctatacttatgataaagagcgttttgatcgctacttttcagattttaaaagaaaatatggaataacagatatgtatacaggtggcttttatccatttgaaacgcttgaagaatactgggcatggtggtcaagacaaatttactgtaatcgctatgaccagccgcaaaatgaagtctatcaaacactgcgcaagcttttacaaacgaaggatttctttgttatcacaacaaatgtagaccatatgtttcaaatcaatggttttgataaaaagcgcttgttttacacacaaggggattatggactttggcaatgtgccaaggcctgtcatcaaaagacctacgataatgaagaaactgttcgaaaaatgattgcgaaacaacacaatatgaaaattccatccaagcttataccttattgtcccatctgtggtgcaccgatgacgatgaacctgcgatgtgatgattcttttgtacaggatcatggctggtatgaggcaagccagcgctacaaggattttatacgtaaatatcagaatatgcacattttatatcttgaacttggtgtaggtggcaatactcctgttattattaaatatccgttttggaaaatgacagcacaaaataaaaaagcagtatatgcgtgcgtaaacttagaagaaataatctatccgaaagaaatagaaaaacaatctatttgtattaatggtgatatatgcaaagtgctgcatgatcttcataactga

SEQ ID NO: 3283 - DNA, 1116 bp, Unknown
  Description of Unknown: Erysipelotrichaceae sequence
atgtgtgatgcatttggtattgtaaattttgaaactgcaaacgtaaatataaagggattaggtgattatcgtccagtatccgcattttcctttttagggagatatcgactggtagattttccaatttcaaatatgagtaacagcggaattaatcatattaaagttctagtaaaatcaaatccaagatcacttgttgaacatttgggaacagggcggcattacaatataaattcaaaaagagggaagctgcatattcttccggctgcttcattagatgataaagatttttataacacagatgtaaatgcattgatgtataatctaaatgcaattgaagatattagtcaaaaatatgtagtgctggcaccaagtcatatggtatatcgtcaggattttagtaaattattagatatccatatggaaagtggtgcagatattacaatgctgtatcaaaatgtagataatgcaaaggaagcatttatcgactgtgatgtggtaaatcttaataaacaaaaaggattgttatcattggaaagaaacagaggaaatgccaaagctcgtgctatttccttagaaacctatgtattaagtaaagagctgtttataactttagtaaaaaaagccgcaaatacaagttctttatattggtttagagatatcgtaaatgatatgtgtacagaattggatattcgaggtgtagcacatcgtggctttgttgcctgcatcaatgatttccaaagctattataaaggaaatatggagcttttggattatgataagggagaagatttgtttgatgataactggccattttacacacgtaccaatgattcctgtccaacacagtattacaaagatattgtagtaagacatagcattatttccaatggatgtaccattgaaggaaatgtaattaatagtgttattggacgtggtgttgaagttaagaaaggtgctgttattgaaaacagtgtcattcttccaggggctgttatcggagaaaatgtacacattaataatgtagtagtggataaacgagcaagaatcgtaaataaaaaagaagtttgttctgtatcagaacatccgctgtacgtgaaaaggaatgataaaatataa

SEQ ID NO: 3284 - DNA, 1563 bp, Unknown
  Description of Unknown: Erysipelotrichaceae sequence
atgtatattataaaaaatgcatggaaaagtattacacgctcaaaaggaagaaatattttaattggaagtattgtgtttattatttcctttgcagcatgtatttctttatctattcagtctgcttctaagaaagcagcggatagtgcaaaagaaggattaagtgtaactgcacagattggtgttgacagacaagcgatgatggaaggaatgcaaaataaagaagatcgccaaagtgccctggaagcaacaaaggagttatctttggaagaattagaagtttatgcgaaagcaaaaagtgtatctgatttttattactctatgtctgcatcattaaatggagaatctatagatgccataaatatgtcagaaaatatgcaagatgataagcagaacgcaggatcctcacagcctggctcttttaaaggtggaaatttcggagtgcagggagattttacaattacagggtatagttcagattctgctatgacagattttattgatggaacaagtacaataacagaaggaaaaatgtttgcatcagcaacaaatgatagtacttgtgtaattagtgcggaattagcatcttataatgatctttcagtaggagataagataacattatctaatccaaataacgaagatgaaacctataaattaacaattagtggaatttatgaaaaagaaacatcagaagattcttccattggaatcatgggtgggtttatgcctggggcagatagttccaatcaaatttatacaagttatgaaacattaaagggaattattgaaaattcaaaagagaatgcagatacagaaacggatagtagcaatggactagttacaacgacggaaattcgttccatgttaaatggaacctatgtattttccacagtagatgcatatgaaaaatttcaagaagaagcaaaaaatatgggactgtcagatgcgtatacgatttcctcagcagatgtattatcttatgaagaaagtcttaagccattacaaagtttaagccaatatgcaggatatttcttattgataattttagtcattggagcttccattcttgttgtgctgcatatcttttccattcgagaaagaaaatatgaaattggtgtattaacagctataggaatgaaaaaatggaaagtatctattcagtttttaatagaagcattgatagtaacttttttagctttatttattggagctgcaggaggtgctgtttcctctgtttcaattaccaatgcgctgctgaaaaatcagatagaagaaacatcgcaacagcaaagtgaccagcgttttggcagagagatggctggaaagcaaggagatatgcagccaggttcaaaagatataggacagatggataaacaagaacataaaaatccatttctacagggaacatacaattatattgacagtgtttcctctgcgacaaatgtaaaagtgattcttgaaatgatgggtataggaattcttttaaccattatatcagggggaactgctttgatttttattatgaggtatgatccattgaaaatattaaatagcagagattag

SEQ ID NO: 3285 - DNA, 903 bp, Unknown
  Description of Unknown: Erysipelotrichaceae sequence
atgaattttggtgttattgatgtaggggcaaatagtgttcgtatgaatgtgtatcaatatgaaaataaagggtttgatattttgttttccaagaagaaaacattaggtatcgtatcttatattaacgatggaaaaatgtcagaaaaggggattcagatattatgtcgctgtctgcatgattttcagttaactttatctcatttgcatattgcttctttacatgtctttgcgacagtacctttacgaaatataaagaatactactgtggtattacaaaaaatatttgaacgaacaggcattcgtgttcatgtgttgtcaggagaagatgagggacgattaagttttgaaggtgcatctatttattcaaaactgcaaaaaggactttttttggatgttggtggaggaagtacagaaatcgtttcttttcaagattgtcaaatgcataatgtatatagtatttccagtggttctttaagtttgtttcgtacatatgtaagtgaaattttaccaaatgaaaaacaacaaaaagaaattatagaagctatgcttagggaattaaaagaaaaagatccaaacaaagaatacgcatcagaaacaatgctggcagctggaggaagtgcacgtgcatgtgcagcgctgttaaaggatttgcatatgattgaaagtacaaaggaagagattccctgtgaaaaactgcaggaattgattacttacttaaacagggaagatgcgattcgtatcattttacgatgtgaaccggaacgtattcatacgttttttccaggacttttaattttatatagtacagcgaactattatggatgtaaaaagatgcaaattagtaaatatggagttcgtgaggggtatgtattgaagaaaattcttccgaatgctcgcttttga

SEQ ID NO: 3286 - DNA, 810 bp, Unknown
  Description of Unknown: Erysipelotrichaceae sequence
atggaatatgtaacacttaatacaggtaataaaatgcctcttgttggtcttggaacatggaatcttagaggagaagaatgtgtacaggttgtatcaaaagcaattcagcttggatatagactaattgatactgcacaaatgtatgaaaatgaaaaagaagttggacaaggtatcttgaaaagtgggattgatcgtaatcaattatttatcacatcaaaaatctatcgcatcagcaacagttatgaaaaagctaagcatgcaattgaagagacacttaataatctgcaattagattatattgatttacttctgatacatgagccttatctgcaaggacctcagatgtatcaggctttagaagaagcatttctaaatggcaaagttagggctattggtatttcgaattatgatgagaacaggtatcaggaatttataaaaaactgtaaaatcattcctgcagtgaatcaagttgaaaatcatgtctattatcaaaaatgggaacttcatgaattactgatgaaacatgggactaccatgcaggcatggtccccacttgctcaaggactgcttaatttatccgatgaaacagttttgaaaaaaatcgcttcaaaatacaataaaacacctgcacagatttccttacgttttttaactcagcgaggaatatccgtagttcctaaatcaaaacatgagttaagattaaaagagaatatagatatttttgattttcatctcacacaggaagaaataaatcaaattcgtcagatagatcaaaatgatactttattttcatggacaaaaaacttctaa

SEQ ID NO: 3287 - DNA, 1344 bp, Unknown
  Description of Unknown: Erysipelotrichaceae sequence
atggaacaaagaggaaaaagcggtttaatgacagaaggtaccatttggaaacaacttcttctattttctgtacctttattgttaggaaatcttttccagcaaatgtataatgctgtcgattctatcgttgtaggtaattatatagggccgcaagctttggcagctgtaggttccagtgccccagtcatcaatttgcttgtcagtatttttatgggaatatcggttggggccggtgttattatttcacgatattttggcgcaagaaacatagaaaatttacaagacagcattcacacatctttagctttcagtattgctgcagggatcattatgactatagtaggcgttcttctttctcctttgatccttcaatggattggaacgccacaagatgttatgggaaattctgtattatatcttcgtatttatttttgtggaatcttatctgttcttgtctataatatgggaagtggaattttacgtgctgtaggagattccaaaaaccctttatattttttaattgtatctagtataacaaatattattctagatttattgtttgttgtcgtattaaaaatggggattgccggagttgggtgggcaaccctgatatcacaaaccatcagtgctattttaactcttatcttattaataaaaacaaagcaggaatataaagtaacacttaaaaagatacggttccataaagaacgcttaatagaaattattcgtttaggtttacctagtggtattcaaaatggtgttgtttctttttcaaatgtcattgtacaaagcaatattaatgcttttggttctgttgcaatggcaggatgtggagcatatacaaaaattgatggttttgcgattctgcctgtcatgagcttctccatggcacttactacatttacaggacaaaatatgggagctaacaaactagaacgtgttcatcaaggtgcgaaaacgggtattttcatgagtgtagctacaaccgtagttatatctattctattggaattgtttggccctcaagttctttctatctttacagataaccagcaggttattcattatggtttgtatatgcttcatatacttgctccttgttatattttccttgcgatatcccatgcatttagcggtattattcgaggggctggtattactaccattcctatgattgttatgattagctgctggtgtgttcttagaatggcatggattctaacaagtgtacctatctttcatgatattggagttgtcttcatgggctggccaattacatggtttgccagtgccttatggttattcttatattataaaaaaggtaactggatgaaacaaaattaa

SEQ ID NO: 3288 - DNA, 1740 bp, Unknown
  Description of Unknown: Erysipelotrichaceae sequence
atgatatttacggcttttttctgttcaagaaatagggaatgtgatatagtagagcatataagaaaagaggaacaatttatgaaaaaatatagtctatatcttataccgttgtatattttatatcttggtatttattattatgttgcattgcctcctttcaactggcatgcacctgaattttggaggtttttgatttttggatttggacctttactgataatcttgctgttatctagcttaacgattcgcgggattcagggggcaagagattttggttctatgtttcatagaaatgtagtaaatgctggtgaggataataaaaaatggaaaacaattacaagggtatgccttgtggcaatcgcagttatcattctttttccatgtgttatgtatggaataaatgtaaaagtttttcatgcgaaagaatatgcaaatcgtattaatataaaaaatgttgagtttagtgaagtacccgaagtagattttacaaaaaccccaatcattgatagagatagttctattcgtttaggggataaagttatgggaaatatgacagagtgggtatcacagtttgatgtaagtcaggaatatacgcaaatatcttataaagatagcgtatatcgtgtaacaccattgacatataatggaattatcaaatactttaaaaatagagggaatgggattcctgcatatataactgttgacagtacaaatggaaaaacagaacttgtaaaattaaaagatttaggtttaggtggaatgaaatatgtaccatccgctatgtttaatgaaaatttaatgcgtaagattcgtttccagcatcctacagaaatctttggttctccttcttttgaaattgatgaacaagggcatccctggtatatttgttcaacgtatacatataaaggtgtaggagctaaaaaacaggtaacaggagctattttccttgatcctattacaggagaaagtacgaagtatgaagctggaaatattccttcctgggctgatcgtgttttccctgaatctctgcttgtacaggaacttgatgacaatggaagtttacaggatggatttattaactctgtatttggacaaaaaggggttactgtaacttctgaaggatataattatttagaaaaagatggagatatctggttatattctggaattacttctgtaaactctgatgaatccaatcttggatttgtattagttaatatgcgtactcatgaagcaatgaaaatcgcaactgcgggagcaaatgaaacaagtgctatgaagagtgcagaagcagaagtaaaaaattatggttatcagtctacattcccactgttaattaatttaaatggtaatccagtctatttaatgtctttgaaggataatggattgattaaaatgtatgcaatggtatctgcgattgattatcagaaagtcgcaacgattagcagtgatgaaagctttgagtctttagcaaaatccatgttaaacgtattaggttcttccaatgaaaacataaatccagatcagttaaaagaagcggacattacagtttctgctgtggaaaaggtaaatctggaaggtacaacatggtattatattgaaagtgaatccaaggatatttttaaagtagctttccaaagtcgttacgaagatactttggttttcttgaagaaaggggatgttcttcatatatcttatgtggataatgaaggtatcaagcaaattaaaggaattgaataa

SEQ ID NO: 3289 - DNA, 969 bp, Unknown
  Description of Unknown: Erysipelotrichaceae sequence
atgaaattggaaataaaatatttgcttgcattcggagctgcactggttttgacattggtcgtaatgccagttctgattccgtttctacataaaattaaatttggacaaagcattcgaaaagaaggaccgaaaagtcatatggcaaaaacaggaacaccaactatgggcgggattgtatttgtacttgtcccaatattggttatgctgatattagattataaagcttttgctacaccggaaatgctgattgtagtgtttgcttatttaggatatgctttcattggctttttagatgatttcttaattgtagtgaaaaagaataatgatggattaaaaccatctgtaaaattcctgttacaatctgttttagcagttgttttctatatttgctacacatatgtagcagatacaagtattgaaatacctgtattgcatcttagtttaaatatagggattttatatttctttttggtatttattatgtttacagcagaaagcaatgcggtgaatttgacagatggattagatggattgtgtgcaggaacatctttaatagcaattgcgccattcattattttttctttgttgaaaggacaacatgatctggcaatgtttttattggctgtaagcggggcattgcttggctatcttcgttttaatttgcaccctgcaaaaatctttatgggagatacaggatctttggcaattggaggtttgcttgcggcaactgccatggttttaaaacaggaacttttgttaattataattggcggtgtatttttaatggaagtcttgtctgttatcattcaagttacaagttttaaattaacaggaaaaagagtttttagaatgtctcctttgcatcatcattttgaattaggcggaatgaaagaaacgcaggttgtgttaatgttttggtgtatcgctcttgtgtttgcagctcttggtttatggttgggagtgatataa

SEQ ID NO: 3290 - DNA, 780 bp, Unknown
  Description of Unknown: Erysipelotrichaceae sequence
atggtattaggaggaaaacaaatggaaaacacgatctttcatgtagataatctaaatttatattatggagaaaaacacgcacttaaaaatgtagcactggatattaagaaaaacaaagttactgcattaattggacctagtggatgcggaaaatcaacctttcttcgctgtttgaatcgtatgaacgatttgattgatggatgccgtatagaaggtacaattgaaattgatggaacggatattcacagcgataaattaaatgttgtagatttgcgtacacaggtaggtatggtatttcagaaaccaaatccattcccaatgtcaatttatgataacattacttacggccctaaatgtcagggtatcaaaaataaaaaagtactggatgaaatcgtacagcagtcattagaaaaagcagccttatgggaagaagtaaaagatcgcttacacgatagtgcatttggtttatcaggtggacagcagcagcgtttatgtatcgcaagagcaatcgccatggaaccagaagtaatcttaatggatgagcctacaagtgcattagaccctattgcgactagtaaaatagaggacttgattgaagaattaaagaaagattatacgattgtaattgtaacacactctatgcagcaggcatctcgtgtcagtgatgatacagctttcttcttattaggggaagtcattgaatttaataatacaagtaagattttccaaaatcctgaggataaacgtacagaagattatattactggtagatttggatag

SEQ ID NO: 3291 - DNA, 1047 bp, Unknown
  Description of Unknown: Erysipelotrichaceae sequence
atgacaaaaattaattatggagaagttatgcagaattttcgagaagaaatcgaagctctgtcaaaaaaagataaaaaggaaattgaacaaaaagattttcctcatcttctttctgctttaccatgcctactagcaaattatccagtcttttctaataaaatagagcgagaagatttagagaagtatgttcatgaacgttttggaattcacgatgaaaaaagtgcggtagaaaatattcacagctttgtcttcaacaacacccaggcacagtttgaatattgtctgaaatattggcaagggcaagcaaaaaatctagatgatgcggatgagaaaaccaaagacttctttaaaaaatgccaggcattcgcaaaagaactatatccagaagtattagatagagggttttgtggctttgattttggagaagctattcgcatggcaaaagaatgttatagtgttgggtatttaagtgaagagggatatcattttatgcttaatgatattgcaaatcgtgctttttacacatttgatagctgggaagattatgctttaagttatgtatgtggaggaacttattatttatattgtaaatctggaggaaatgaagagtttgcgaaaaaaatgtgtgaaacacttatgggtggcatacgtgaactttataaagaaaatggtctatgggcagaaagtgcatggccaaaaggtaaacgttattttcgatttttaaaagatgttaaaaaagtgattgaaagcaaggaagcaggccttgtaagtgatcgtattagtattgatggaggaaacattaactatatggttcgtatccagccagtagaaggaacaacagatagtggatggcaattcttccatggagatgaatcaaaagaatatttagaaaatgtatcaaatacacaattatttcaattaaatgttatatgcaatatggattcatccatcattcctttactggattccccagtaggaaccgcttatagaagaacaaaagatggtacatttgtaaaagttgaagttaaaaaggtgctccaaaaatag

SEQ ID NO: 3292 - DNA, 1548 bp, Unknown
  Description of Unknown: Erysipelotrichaceae sequence
ttggaaggaggcttttttatgcttcgtaaaattttatctttgttacataataaaatctttattgttggggtattgatccttattcagctggcagtgttttttggtattgtctttaaattaagcgaatacttcgtggcaatttatttctttttgattgcccttagctttatcattagtatttatatagtaaataaagatgataatccgacatataagatgacatgggtcatgttgatcatggggctccctgtttttggcggtttgatttatttgttgtttggcggtcagaaagtacctaaggaacttcgtgttcgtgacaatgaagcggcaaaaaaatatccgggaattttttggcagaatgcagaaattatggaagaattgcaggaagaagattcaaatgcatttaaacaggcaaattatttgtggaaaaatgcacgttttccaatttataaacaaacagaaacaacattctttccaattggagaagaaaagtttaaggcaattgtagaaaaattgaaaaaagcggaaaaatttatatttttagaatatttcattattgccccaggtattatgtgggatacgattttggatattttgattcaaaaagtgaaagaaggcgtagaagttcgtgtgctgtatgatgattttggatgtattacaacgcttcagcctgattatgcacaggttttatgtaaattaggtattaagacaaaggtgtttaatccgattcgtccaagactggctattcagatgaacaaccgcgatcatcgtaaaatacttattattgatggaaaagttggaatgacaggtggaattaaccttgcggatgaatatataaataaaaaagaacgttttggacattggaaagattgcggcgtcatgttgaaaggggaagctgtatggaatcttacgatgatgtttttacagttttggaattacgatgaagatgtaaaagatgactttttccaatataaagcagaaaatatgaattttaaaaacgatggttttgtacagccttatagtgacagtcctacggattctgaaaacataggggaatacacacatatcaatatgattaatggtgcgaattcttatgtgtatgcgacaacgccttatttagttattgataatgaaatgaaaacagcattgatattagctgcgaaaaatggaattgatgtacgtatcttagttcctcatattcctgataaatggtatgtatttatggtaacacgttctaattatcgttcattaattgaagctggtgttaaaatttatgaatatacaccaggttttgtacatggaaaaacgtttgtagtagatgataagatggcagttgttggaacggtaaatatggattatcgatcttactatcttcattatgaatgtggtgtatggttttataaaagcaaagttgttatggatgttaagaaagactatttggaaactttggaaaaatcacagcagattactttagaagattgtttaaaggtaaaacttccagttcgtatcttgcgctctattttaaatttattttctcctatgatgtaa

SEQ ID NO: 3293 - DNA, 1251 bp, Unknown
  Description of Unknown: Erysipelotrichaceae sequence
ttggaaagagggtttggtatgattgagttttttaagaaaaatatagaaccgaaaagctggttaagaaaagttgaaatcatctttttaatcttattgtgcattggttctattgcatcatttggatttggattagtaaaaatgaatgcggatgttgggcagacgcagtttgtgaatacgatccaaatgacaagagatatggatttagaggattatagtgaagataatacgatttgtgatgttacctataaaaatggggataagcaattagttgtatcatactcctatgaggattatttgaagctgaatacaaaaacaattacagcttatgagtataaaacagaaaatggtacaagcttatattttgatcataaaaatgtaacaaaacaagaagtacaggattcttataaacaggtaatggcaaatgatttggcaccggtatttaactttggaattgcttctttaattctggtactatctattttgatcatgatgcttttcgcaagacagtttacaacatatgagaaatcatggtttatgtctatcatggtactggcaacgattttctctgttcttttcccagaagaaagtgcaaatggagtcaatggtattttgatcatgctgttgtatttgctggataccttcttgaatattctttgtgaattgctgatttcaaaacagtcaagatacaatttccttgtttctgttttagttgaaatcgtagaaatcttaatgtgtgttgtattaatgtatcgttttgcgacaatggcaacgacattattcttctggcttccaattgatattatcagttacatcaactggtcaaaacataaagatgatgaagaaagtgaattgacagttgtacgtaaattaaaaggatatcaggaagtattggttattgtgggaatcattctttggacaattgttgttggatactttattagtggattagacattgcgacagatttctatcataacaaaacattggaaactgcaattatctatattgatgcctgtgcatctgcggtaggaatcgcaaatggtctgtttattttcttcagacttcgagaacagtggattgcatggtatatatgtgcctttttagaagccattataaatattgtatccggacagtttgttctacttgttttaaaactaggttattttacgaatacgacttacggatatatcaaatggagtaaatatatacagtcacatacaaaaacagaggaaaaacagccacaaatatcttaa

SEQ ID NO: 3294 - DNA, 918 bp, Unknown
  Description of Unknown: Erysipelotrichaceae sequence
atgaataagaaagaaattggtcttgatcgctggcagattcaaatgcaggcaagctcttttttgaatttatgtaaaaaacagtctatcgatgtatttgactgtacattcaagaattcacatataagtttctattcacctgtatttgaacgcatgcatatacatcacacatttcctgatgcagttttacttaatacaacagggatgttaggatatttttttcgttctttaaaaaagcctgcatttgttatttctattttactttctataggattgtggatgtttttatcacagtttgttttctcggtggaaattcatggggaagattcaatgtgtaaaaaagcaattcaggatacgatgcattccttaggctataacattcctttttccgcagatgaaagcgagataaaaaaagagttgaaaatgagattgtctgataaagtagcatggctggaagttgaaaaacaagggagcagtctgcacattgcttatacaccaaaagaacacgcgcaaataaagcaaacttcaagaaaacagctgtatgcgttaaaagatggtatgattgcaagatttgatattaaacatggagaaaaaatcgcaaaggtaaaccagatcgttcataaaggagacttgcttgtagcaaactctttaagtgacagtaaagggagtttgcaggaattagatgttgagggcagagtgtatgcttatacatggaaagatgtagtagtttatgcaaagccgcaggatataaaagctttctcttattttgaaatgcttatggaagctagaagagaagttacaaaagattttcataaagaagatgaaatcatagcagaaaatgttttgcaattcacaaaagaactgggtaaaataaagatggtgattcattatacaatgcttcaagatattacatcaccataa

SEQ ID NO: 3295 - DNA, 714 bp, Unknown
  Description of Unknown: Erysipelotrichaceae sequence
atgccaatatattattatccttcgttttcatcacaatatcttctgtatttattaggtattcttattgtattatatgcacagggacgagtaagttctgcgtataataaatataagcaaatacctaataaaaagggaatacgtggggtagatgcggcacgcattatattagatagaaatggtttacaggatgtacgtatcgaaccagcgaaaggcggaacattaagtgatcattatgatcctgtgcatcgcgtagttcgcttatcatctgatatttactataatgcaagtattgcatctgtcagcgttgctgcacatgaatgtggacatgcgatacagcataaagtagggtatgcagctttatcctggagatcaaaactattaccagtagcaaacatttgttcgcagttaggctggatcacgctgattcttggattgtttcttttttccagtttttcatcattggtttatcttggaattgggatgattttagtagtctttttattccaggttgtaacattaccggtagaatttaatgcatctactcgagcaattgcacagatatctgaattgcagttaatgcaggatgatgaaagacctatggtaagaagtatgttaaaggctgcagcatttacatatgtagcatctgttttatcaacattactacaaatttttagaattctaataatggtattaggcagaagaaataacgactaa

SEQ ID NO: 3296 - DNA, 846 bp, Unknown
  Description of Unknown: Erysipelotrichaceae sequence
atgaaaaaaagaacatggataatagtgttggctgtagttatggttatcgttacaggtgtttggctttggtggggaaacagtgcattgcagatgcatcatataaacattgccaataaaaagatacccacttcttttcaagggtatcgtattgtacatttatctgatttgcataatgcacagtttggagatgataatgaaaaactgctaagcatgatcaataaagaaaacccagacatgattgcgattagcggagatttaattgattctagaaaaacaaatgtatcgatcgcattggattttttggaaaaagcacaaaagattgctccatgttattatgtaaacggcaatcatgaagctgcaagttctgaatatgaatcgttaaagaagaaaatgaaagcgctcggtatcactgttttggaagatgaaaaaaccatactgaaaaaaggtaaagaaagtataacattgatggggttacaagatcctgcttttacatcggattatctttttactgatacaaaagaaacagcacttgaaaatttgatgtctgataaaaagagtgaagattatacgattctgttatctcatcgaccggaattatttttaaaatatgcagatgcacaggtagatttagtgttaagtggtcatgcgcatggcggacaaattcgtcttccttttcttggaggaattgtagcaccaaatcaaggtttattcccaaaatatgatggtggtgtatatacgcacgaaaagactaccatgattgtaagcagaggacttggaaacagtatccttccattgcgtatcaataatcgaccagaaatcattgtgatagatttgcaaactaagtaa

SEQ ID NO: 3297 - DNA, 1266 bp, Unknown
  Description of Unknown: Erysipelotrichaceae sequence
atggaagaagtaataaaaattaaaggtggcaaaaaactaaatggtacagttcgcattggaggttccaaaaatgcgacagtagcacttattcctgcttccattcttgcgaatggacctgttacgatttgtggtgttcctagtatttctgatgtagagtccttatctgttcttcttcaggatctaggtgttatggtggatgtacgttcatcagatagtattttgattgatacagaaaatatgcagaataaaccattggtacatgatgcagttaataaattaagagcttcttattattttatgggagcattattaggaaaatatggacatgtagagattcgtatgcctggtggatgttatttagggcctcgtccgattgatttacatttgaaaggttttgaggcattgggggcaacagtaaaatatgatcatggatgttatgttttagatgcacctgaacttgttggtacaaaaatctttttggatattgccagtgtaggtgctaccatcaatattatgatggcagctgtacatgcgaaaggcagaacgacgattgaaaatgccgcaaaagaaccggaaatcatcgatgtggcgactttattgaataaaatgggagcacaaatacgtggggcaggaaccaatgtcattaccattgatggtgtggatgagttaagtggctgtttccatgaaattattcctgatcgtattgaagcagctacgtacattgttttagctgctgcagccggtgaagaagtaaaaattgaaaatattattccacatcacttagaatctttaacaagtaaactaacagaactaggtgttgatatgaagattgatatcgacagtattacgattcatggaggtttggataatcttcatccaattgatattaaaacacttccatatccaggctttgcgacagatatccagcagcctttaactgcacttttaacacaggcacagggacagtcaatcgttacagaaacgatttatacagaacgttttaaacattgttttgaactggaaaaaatgggagcgaaaatcaatgtgatgacaccaagctcttttatcaatggaccaactcctttatctggtgcagaagttagcgcaaccgatcttcgctgtggagcttgccttgtgattgctggattgattgcggatggggttactaccattcgaaatatttatcatattgaacgcggatatgaacatattgtagaaaagctgactgccataggagctcaaatttggcgtgaggaaatcaactaa

SEQ ID NO: 3298 - DNA, 1332 bp, Unknown
  Description of Unknown: Erysipelotrichaceae sequence
atgttgaaagatacgattgcagcgatttctactgcagcagttgatggtgcaatttccattgttcgattaagtggagatgacgcaatagaaattgccaatagcatcgcaagtataaatttattgaataaaaaaagtcatacgataagttatggtttcattgttgatcctattacattacaggagattgatgaagtgttatttagtgtttttaaagcacctaaaacgttcacaagagaagatatagtggaaatcaattgtcatggaggcagatttgttacaaaaaaaatactctctctttgtttgatgcagggggcaagattagcagaacctggagaatttactagacgagcatttttaaatggtagaattgatttaacacaggctgaagcaattaatgatatgatactggcagattctaatgaaaatatgaaactggctattcatggaattaaaggaagtgttaaaaaattattagatcctttactggaaaatattttagatattattgcgaatattgaagtgaacattgattatccagaatatgatgatgtggaaatgttgacaaatgatgtggtgcttccaaaagcaaaagcatggttagatagtattgatacaattttagatagagcacaaagtggaaaaattatgaaagaaggtattcgcaccgcaatcgtagggaaaccgaatgttggaaaaagcagccttttaaatgcattgctggaagaagataaggcaattgttacagacattgcaggtacgacaagagatatagtggaaggtcatattcatttaggtggattgacattgaatttgattgatacagcagggattcgtgatacagaagatgttgtagagaagattggtattcaaagaagtttacaggcaatggaggatgcacagctggtaattgttgtattagatggaagccgtccattggatgagcaggatgatgaactgttagaaatgacaaaagaaaaaactagaattgttgtgtataataaaaatgatttatatgaggtagcggatgggatttctattagtgcagtcaaacaggaaatcacacctttggtaaataaaatacatgaattgtttgaccatcataaaatcgcaattgaagaacctgtattaggaaatgaaagacagattggatttatgatgaaggcaaaacaatcgatgcttcaagctgttgaggcaatggaaaatggattggagcttgatcttgtggaaattgatattcaagatgcctatacagcattaaaagaaattttaggagaagtacatagagaagatctcttggatacacttttctctaatttctgtttaggaaaataa

SEQ ID NO: 3299 - DNA, 1893 bp, Unknown
  Description of Unknown: Erysipelotrichaceae sequence
atgagagtacaaaaaaatcgcagagtaaaagccgatcaggagacgatgaaggtacttgggcgattgattggttatgttcttaaaaattatcgcttcgcatgtatctttgtgttgctgtttattattattagttcattggcttctgttaccagttctttgtttttaaaaagtttgattgatgactatattacccctatcttagtaagtgagggtgcagcagattttactcctttatttattgcactatgtaaaatggcagctatttatggagtaggcgttttatctacctatttatatgcacgtattcttatcaatgtggcacaggggacaatgaagcgtattcgtgatgatttgttttctcacatggagaaacttccaattcgctattttgatacaaatccgcatggagatatcatgtctgtgtataccaatgataccgataccttaagacaagttatttcacaaagtattccacagtttctggcatctttgattacggttgtcagtgtctttatttccatgtgcgtattaagtttgtatttaactttcattgttgttattatgcttatcgttatgaaggtagctatgagtaaaattgctggacaaagtggtgtttattttaccaaacagcagcaaaaccttgggaaagtaaatggctatattgaagaaatgatgaatggacaaaaagtaattaaagtatttacacatgaagaagaaacaaagcaagggtttgataaagtaaatgaagaattgtttgaaagtgcatatcaggcaaataagtatgccaatatcttaatgccggttatggggaatttaggaaatatatcctatgtacttaccgctttggttggaggacttgtcgcaattcatggtataggtggattaacgcttggaggactagctagtttcttgcagttaaatcgttcctttacgatgccaattacacagatatctcagcagttaaacttcgttatcatggcagcagcaggggcaaaacgtatttttgcgttaatggacgaagagtgtgaagtagatgaaggaattgttaccttagtcaaaataaaagaagaaaatggaacgtttgtagaaagtgaaacagatgatgcaagatgggcatggaagcatcctcgtcaagatgggaaagcagtttatgtaccattagttggaaatgttatctttgataatgttaactttgggtatacagataagaaacagatattatatgatattaatctatttgctgatcagggacagaaagttgcgtttgttggggcaactggtgctgggaaaacaacgattacgaatctgattaatcgcttctatgatattcaaagcggaacaataacgtatgatggcatagatattaagctgataaaaaaagatgatctgcgtcgctctttgggtattgttttacaggatacacatttatttacaggaacaattcgtgataatattcgttatgggaaggcggatgccagtgatgaggaagttattgcggccgctaaattagcaaatgcccatggttttattcgtcacttagaaaatggttatgatacgatcattagtggagatggggcttctttatcacagggacaaagacagctgttatcaattgccagagctgcactcgccaactcacctgtactgattttagatgaagcaacttcttctattgattctcatactgaaaaaatagtacaggatggaatggataaattgatgaaaggacgtaccgtatttgttattgcacaccgtttatcaacgattcgaaattcagatgttatcatggttatggatcagggacatattattgaacgtggaaatcatgaaaaactgatgaaggaaaaaggtacatattatcagctgtatacaggtggattagaattggattaa

SEQ ID NO: 3300 - DNA, 936 bp, Unknown
  Description of Unknown: Erysipelotrichaceae sequence
atggttacacaaacaagaaaattaacagaaggagctatgatggtagctttggttggcttgatgttgtttgtaaatctacagcttggaggtatgccggaagctttgatgtactggatcttgacgtttcctattttgatctatactgcaaaatatggaatcaggaatggacttattgcggcatttagtacaacgctcctttcttttatgatttcttcaccgacaaccattttctatttgtttagctgcaatgtttgtggattgttttatggtgaagggataagaaaaaaatggaaaaacggagtattgtatatgggaactgcagtttttacatttctttcttatttggtaacaacgttttttctagcatctttatttggatatgatcccaaggaagacatagaaatgataagtcaattattatctttgtttcatataggacaggatttagacttggcaaaactaacgggaatgatcattctggtatcaacgattctgttaagtgcgatgcaggcgttgtgcattcatttatttgcacacgttttgcttatgcgtttgcatatagaaacaagaaagataaaaacaatctttgaaatacatcttccatcttatgcaggattgcttatcttcttcatttgggtgctgtattttatgcgaaatgtgataaaattaaaccaagaggttttaggaatccttgtgttcttatatgggatagcgaaagttactgccattttttatggggtaatttctctgtgctatgcactgcttttatcaaaacagaagaaatttgtatttcttgttttgctggcagcatttgtaccgtatgtgcagatggccattggctgtattggtattttggatatgtttatcgatttaaaagatatttatttgcaaatatggaaacgaggtgtcattcgtggatcgtctggagaattttaa
